United States Patent 7,745,391 (HUMAN THROMBOSPONDIN POLYPEPTIDE) - sequence listing, part 181

SEQ ID NO: 444078 - DNA, 387 bp, Homo sapiens
gccaactgtcttcctctggtagatatcactcaccccatcccagacttgactggctacattacagaggggcagatctatgtggacagacagctgcacaacagacaggtactggacgggagcagtgctgggaagcttgcagacctgctcatccgttattctttagtgacttggattttgctcttaggaattgctttgcttagaaagtatcaacttgaattgtttttaatatggttataaaattgtcatttctattatcttaaattctggtgtcggcagagcgccagaattaagaatcttcttaacactttcctttattgtgtcttaaaacagagtcacttgtctccaagaacttttttgggaattctgttccataatggtatcatctac

SEQ ID NO: 444079 - DNA, 2881 bp, Homo sapiens
agggagaacaacataggttaggtgcaggcctgggtggctcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatgga

SEQ ID NO: 444080 - DNA, 2812 bp, Homo sapiens
gcgcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttgagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatgga

SEQ ID NO: 444081 - DNA, 2807 bp, Homo sapiens
gcgcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatgga

SEQ ID NO: 444082 - DNA, 2039 bp, Homo sapiens
gcgcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtccttacgaaaatcgcactgtctttgagactttggacattggctggcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatgga

SEQ ID NO: 444083 - DNA, 676 bp, Homo sapiens
gtcgatggaagctcactcacagacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatgga

SEQ ID NO: 444084 - DNA, 743 bp, Homo sapiens
gcgcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgaggtgaggactgggatcggtttgctatgaagtttagcagacaagaatttctataatgcatcactgttactgagaaaccgaataaagggttttcaaaataa

SEQ ID NO: 444085 - DNA, 346 bp, Homo sapiens
tgtgtgagtgggtgtgtatttaacagctttactgcaatataattcacataccatctaattcacccactgaaagtgccattcagtgatttttagtatagtcacagagtgtgcaaccatcacaatcaatgttacaacattttcatattctctccccacccccaaaagactgtacccattagaagccactctccatttctccccaaccctaccagtcccgggcggctactgatctttctctgtccatggatttgcctgttctggattttctttttttttctttcagacggagtctcattctgtcgcccaggctggagtgagtggcgtgatctcagctcactgcaacctc

SEQ ID NO: 444086 - DNA, 2866 bp, Homo sapiens
gcgcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatgga

SEQ ID NO: 444087 - DNA, 3142 bp, Homo sapiens
gcgcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatggaaaaaaaaaaaacgaacaaaacactaaagcactcacatggttgtttggagcgccatgagcgccaccgaaaaaagtgttaagaccacatcggtgggggcagcgggccccagtaggtaagtagaccatggcccaatagctggttcacaaagagcgacccgcgggccagcacaacggggtgattcccccaaagaaaacgcgcggggaaccggaccgcttgaacaaccacaggagaccgaggcaagggggtccaagggcacgaggcgacaataccccggtg

SEQ ID NO: 444088 - DNA, 3006 bp, Homo sapiens
agggagaacaacataggttaggtgcaggcctgggtggctcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcagctataccatttctccaatttcctttgtgacttttgtcacttctgcgtaacattaaggattccctttcctcatctacttagctaaatgctgcgtcctctataaagtttttacttttctccctgagcatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatgga

SEQ ID NO: 444089 - DNA, 2118 bp, Homo sapiens
gcgcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtgtctcactttgtcgcccaggctggagtacagtggtgcgatcttgactgactgcaacctgcaacctctgcctccggactcaagcgattctcttgccttagcctcctgagtagctgggattacaggagaccccaggaactgaagtggcaagggtgaatcctgtgagacgatgaggaatgagaccaggctgaagtgtgagatgcagtagccctcctccacctccaccagaaggcaggggtggaataagagctgaaagacggagtctcattctgtcgcccaggctggagtgagtggcgtgatctcagctcactgcaacctccatctcccaggttcaagtgattctcatgcctcagcctctcgagtagctggaatgataggcgcgcaccgccatgcctggcgaatttttgtgtttttagtagagacggggtttcaccatgttggccaggctggtcttgaattcctgacctcaagtgatccactcttctcgacctcccaaagtgttgggattataggcgtgagccaccgcgcccggcctgttctggatatttcttataaatggaatcatacagtgcttctttcagttagcataatgtttcccaggttcatccaggtcataacacataatcaggcttcatttctttttattaccaaataatattatatgaatatactactttgtg

SEQ ID NO: 444090 - DNA, 2468 bp, Homo sapiens
tgtttgaacgtaaggaggaagtcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagca

SEQ ID NO: 444091 - DNA, 646 bp, Homo sapiens
cccatcttcgccccatcagtattgcacatccttagagagggatcattgcacctgataagccccagacttccttgaggacaaagctgcagttagagcctcccccatgagtttgcaccttattaaatcagaaggcgagaacatgtagcctgtgatttgcctcttctgcatgacagccagcaaatgtcggaagccctgtggtctctcaagtttcacgaaaaactaagtcagtgccctcagagtgaggagcagatatccattaggaagggcactttttataggtctgtttcttgatactgagaatgaaagaaaaagcctttcgtttaagggcatcctcttccctctttgcagcagaggccaaagtgtgtatgcatcgcccactgcttgaaacctgggggggattttccatccagagatatcaggtgtgtttccaaggacaacttttgaatatattaaagcttgaatactcctcccaagtcagtgtttgctgaggccctactgtgcacagaacacaatgccacatcctctgggagaagactgggcccatcagggccaactagtagctgattcttctcttcatcagcttgtccttcttagtcactccgaataaattagagaaaattagttcacatactgatgggagagtctg

SEQ ID NO: 444092 - DNA, 534 bp, Homo sapiens
  misc_feature (69)..(69): n is a, c, g, or t
  misc_feature (71)..(71): n is a, c, g, or t
cgccgtcatcgtaaggcgcgttctgtaacttggccataaacctgtttccgtcaagattgcctccatcangnaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttgccatatgcaattgcatatggcaaggccaagaatcgtttcttattgtatcttttatttaggtgccaaggtataacccactgcttgaacttgtgccagatgattcttcc

SEQ ID NO: 444093 - DNA, 447 bp, Homo sapiens
ggctaatttttgtgtttttggtacagagggagtttcgccatgttgaccgggctggtctcgggctcctagcctcaagtgattggcccgcctgggcctcccagggtgctgggattacaggtgtgagccactgcagcccagcctacgaagttgtttttgcggttaagcagcaatttggaaacgaagcatttctgaggagctcagtttaagaaacactgtgatgttgtgttttaaacctatgaactcccctccgtagctcatccctctacttttccatctaaccccagtactggcaccttctctatgattagtaaatttcttcagctagaaatgttacagtctgttttttaacaatgaagtcaggacccagtggattatagcattgttacacttcatgctcatgttatataaaattgcataaaatgtattaaaatttatgtctgctcttat

SEQ ID NO: 444094 - DNA, 441 bp, Homo sapiens
tttttgatttttggcatccttatctggactgcctttctttaggaataaacagatgatacagagcaaagtttgtaaatctcaaatgcagcggttaacctctttgaggctggcccactgggtcccaggggcagcttctaagtgggaaatgtttcgatggaattctggttacataaggaagttgctttgaaaatctgggatagttttctataatggaatcattcccttgtgtctttattcacgatgaagtgtagagtgaaagatgcctccactgggggtattggtgcacgagaaaagccacctgtgtgacgtaaattcattctgtttaggcaaagctgggactgccacattggcaatgtcagagaaggtgcggacccggctggaggagctggatgactttgaggaggtgagcaagtcatttgtggaatacagggagtgggagag

SEQ ID NO: 444095 - DNA, 96 bp, Homo sapiens
aaaaaagttttatgtgatatgattctgatgtttgattcagttggagctgctatttcttagattgtggatagacgtagaaataaaatacatatttag

SEQ ID NO: 444096 - DNA, 3144 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccaggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444097 - DNA, 2323 bp, Homo sapiens
  misc_feature (9)..(9): n is a, c, g, or t
atatacgantcgagccgtacctgtcatatggcaaggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444098 - DNA, 3035 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggctgagaaacggctaccacatccaaatccagaaagatctgctctgctgcccttgact

SEQ ID NO: 444099 - DNA, 3168 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatgagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444100 - DNA, 2500 bp, Homo sapiens
cccatcttcgccccatcagtattgcacatccttagagagggatcattgcacctgataagccccagacttccttgaggacaaagctgcagttagagcctcccccatgagtttgcaccttattaaatcagaaggcgagaacatgtagcctgtgatttgcctcttctgcatgacagccagcaaatgtcggaagccctgtggtctctcaagtttcacgaaaaactaagtcagtgccctcagagtgaggagcagatatccattaggaagggcactttttataggtctgtttcttgatactgagaatgaaagaaaaagcctttcgtttaagggcatcctcttccctctttgcagcagaggccaaagtgtgtatgcatcgcccactgcttgaaacctgggggggattttccatccagagatatcaggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444101 - DNA, 2342 bp, Homo sapiens
ggattatattagaggcagtggctaagaatgtcggccgcagggccagagtgcctgggttgaattctaactcttacatttgcttgctgtgtgccttgggggaatttcagagtgcctgccccggttgacatgcatgatcagagggatcggagacccactagtgtcggtgtatgcccgtgcctacctgtgccggcagaggccaaagtgtgtatgcatcgcccactgcttgaaacctgggggggattttccatccagagatatcaggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444102 - DNA, 1571 bp, Homo sapiens
tggttcctttttcctgcttagaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444103 - DNA, 1128 bp, Homo sapiens
ctcgcactacttatcaccacacgcatacacaacgcacactaaaaaactttatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444104 - DNA, 1555 bp, Homo sapiens
  misc_feature (1524)..(1524): n is a, c, g, or t
  misc_feature (1527)..(1527): n is a, c, g, or t
  misc_feature (1531)..(1531): n is a, c, g, or t
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttcttgttaggncantggnattaaaaaaggccttgcgatatag

SEQ ID NO: 444105 - DNA, 1538 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacatttatttgtgccgaagtgtgggtgggaattcaccctggagcatttcacgaacgagaagggaatccggtgggggatggttcagcctgatccgaatccggttggaaatc

SEQ ID NO: 444106 - DNA, 1532 bp, Homo sapiens
  misc_feature (1487)..(1487): n is a, c, g, or t
  misc_feature (1510)..(1510): n is a, c, g, or t
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttgccatatgcaagcaggccaaggtcagaagatgaaccacgtgcgnaatagaaaaagctacctatggantgtgcccgagatcctctagagt

SEQ ID NO: 444107 - DNA, 1244 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccaggtaatgtcgcagctgttcctggggtgtcattctgccctggagtcaggactagaaggcttttattgagtcaggattcattgaagcttgataaaggttttaattttgggtgtgttaaagtaaaagaaacacctttgaagatttctgatcacctcagtcttctaaaaacattagaaggtttctaaatggcccgtgtaggaactcaggcaagtcatttgaatctgcaaaggcctcacagttagattcagccaaactttcacacgaacatattttcctctgctgcttgactttaatatttttcctatgtatcgttccctcctaagaagcaacttgcttgg

SEQ ID NO: 444108 - DNA, 574 bp, Homo sapiens
gagtagaaatttgaatctccagtggtttttagtgactgtatttttcttctttgaatatatatttctttctcttgggtatgtaaatggctctgttggaaaacaatgaacatactgccttcgatttttaaaatattaatgaattttatgtctctgcagaatctgtttatgggatctgaaaaaggtaagatgagtttgttgttgttttgatgggaaaattctggcattacttttagtataattttacaaaggaaaaaagttttatgtgatatgattctgatgtttgattcagttggagctgctatttcttagattgtggatagacgtagaaataaaatacatatttagagcatgaattaaaaaaataccaaataccagcactttgggaggccaaggtgggtggatcatctgaggtcaggaagtttggtaccagcctggccaacatggtgaaatctcgtctctattaaaaatacaaaaatttgctgggcgtggtggcgcacgcccgtaatcccagctactcaggaggctgaagcaggagaatcacttgaacctgagaggcggaggtttcagtgagcca

SEQ ID NO: 444109 - DNA, 496 bp, Homo sapiens
agcctgtctgggcgatgatagctctgggtccctaattaacaaacatttatttactgtttgctcctgaagagtgtgatactaacaccatctgtccttttcctcccaggaaagctcgtgtacgagcgcatcttttccatgtgtgtggatagccgcagcgtcttaccaggtaatgtcgcagctgttcctggggtgtcattctgccctggagtcaggactagaaggcttttattgagtcaggattcattgaagcttgataaaggttttaattttgggtgtgttaaagtaaaagaaacacctttgaagatttctgatcacctcagtcttctaaaaacattagaaggtttctaaatggcccgtgtaggaactcaggcaagtcatttgaatctgcaaaggcctcacagttagattcagccaaactttcacacgaacatattttcctctgctgcttgactttaatatttttcctatgtatcgttccctcctaagaagcaacttg

SEQ ID NO: 444110 - DNA, 3229 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444111 - DNA, 3747 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagcatttatgttcatgactgttcatttaattacttctgactgtcttcctccagaagagaaagaccgtgtctaaatatattatcctg

SEQ ID NO: 444112 - DNA, 3665 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagca

SEQ ID NO: 444113 - DNA, 3028 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444114 - DNA, 3074 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggtgggtgccctctgctgtcctccacccgccccttgctctgaaagcacaagtttccagggtggttcaaccttggttcattctagaaaggaaactatgtcatgtgagtaatgtgtttatgtgcaaaccacttctccattgctttggggccttcgctcctgctgttttctctgcctggactgcgcctcccccagggcttcccctggctgttccttctcgtcattgaaatctcagctcaaaggacctcctcaggccttcccggaccctgtctgaaggagccaccaccacctgcatgcctctgcccga

SEQ ID NO: 444115 - DNA, 2487 bp, Homo sapiens
ggattatattagaggcagtggctaagaatgtcggccgcagggccagagtgcctgggttgaattctaactcttacatttgcttgctgtgtgccttggatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccggcagaggccaaagtgtgtatgcatcgcccactgcttgaaacctgggggggattttccatccagagatatcaggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444116 - DNA, 1991 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444117 - DNA, 1635 bp, Homo sapiens
  misc_feature (1590)..(1590): n is a, c, g, or t
  misc_feature (1613)..(1613): n is a, c, g, or t
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttgccatatgcaagcaggccaaggtcagaagatgaaccacgtgcgnaatagaaaaagctacctatggantgtgcccgagatcctctagagt

SEQ ID NO: 444118 - DNA, 1458 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaacgcgttgctgctgaattctacgatgtagtccattccgggacagagtataatcaccaacagga

SEQ ID NO: 444119 - DNA, 584 bp, Homo sapiens
atacatggcagagctggcactggaactcaggcatgacctaccccagagtcagcactgtccacagcatctctgcggggcacggcctgagccccagtgcaaggcagtaacctcccttttctgtttcaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaga

SEQ ID NO: 444120 - DNA, 1166 bp, Homo sapiens
  misc_feature (11)..(11): n is a, c, g, or t
gtttggctggnttccgtggaggggtggggtggcaggtggaggatattgagacagggtctcactctgtggcccaggctgcagtgagctatgatcacaccgctgcactccagcctgggtgatagagcaggaccttgtctccaaaacaaagaacaaaagcatagccttaaaagtctattccctctgaataggaaccatacatacaaaacatcagtcatttctggtcacgtccaaatctgatttttagggcaagctgcaatccaagaagttgaagactttgatttcttccctcctctcatccctcaaaaaactcactcttctctgctaagaaatctaagctcacataatggctgattcattagagccttgggctccaaggataatgaaccagaaaggagatggatctttctttttcctcataggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagca

SEQ ID NO: 444121 - DNA, 877 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctatttgctgggattacaggtgtgagccactgcagcccagcctacgaagttgtttttgcggttaagcagcaatttggaaacgaagcatttctgaggagctcagtttaagaaacactgtgatgttgtgttttaaacctatgaactcccctccgtagctcatccctctacttttccatctaaccccagtactggcaccttctctatgattagtaaatttcttcagctagaaatgttacagtctgttttttaacaatgaagtcaggacccagtggattatagcattgttacacttcatgctcatgttatataaaattgcataaaatgtattaaaatttatgtctgctcttat

SEQ ID NO: 444122 - DNA, 540 bp, Homo sapiens
gcggccgcctactactactactactgctcgaattcaagcttctaacgatgtacggggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaa

SEQ ID NO: 444123 - DNA, 5113 bp, Homo sapiens
  misc_feature (2483)..(2483): n is a, c, g, or t
cactctctgttgtccaatggacacacctgtcgtgttttgagccagcgagagatgcagtggaagtgaaaagcatggttacagactccccatgcgacagtacactcttctgaagtagcggacgcctggttagcttgacattctatgcaaagatccataatgtggttcctgcagatggcacagttatcaaccacaatatcccaggcccagagggctactgcattccactttttcacttcaaagcgcttcttgcccgcgccgctgttggtgccgctcggggtatccacatccatcgctgcgggctcacaaagcggccagacgctcggcggcggcgtgtggcaggagcgcaggggcgcgagccggcgatcagccttcccggcgaccgtgccgcgggagctcgagcaactcggactaggggacccgggccggcccccaagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgttttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatnttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaa

SEQ ID NO: 444124 - DNA, 4577 bp, Homo sapiens
  misc_feature (1947)..(1947): n is a, c, g, or t
agcgggctggtacgtcatcaccaaagccaatctgctctagctgcccacagatgccaccaaaacctgctatctcttcatcaccaggatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgttttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatnttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaa

SEQ ID NO: 444125 - DNA, 1978 bp, Homo sapiens
  misc_feature (55)..(55): n is a, c, g, or t
cagcttgatgctgcaggtcatctagagatcccccagcagcatagatattaccgcnattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaa

SEQ ID NO: 444126 - DNA, 361 bp, Homo sapiens
cttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaatatctgagtgtttgtatttcattggg

SEQ ID NO: 444127 - DNA, 5371 bp, Homo sapiens
  misc_feature (2483)..(2483): n is a, c, g, or t
cactctctgttgtccaatggacacacctgtcgtgttttgagccagcgagagatgcagtggaagtgaaaagcatggttacagactccccatgcgacagtacactcttctgaagtagcggacgcctggttagcttgacattctatgcaaagatccataatgtggttcctgcagatggcacagttatcaaccacaatatcccaggcccagagggctactgcattccactttttcacttcaaagcgcttcttgcccgcgccgctgttggtgccgctcggggtatccacatccatcgctgcgggctcacaaagcggccagacgctcggcggcggcgtgtggcaggagcgcaggggcgcgagccggcgatcagccttcccggcgaccgtgccgcgggagctcgagcaactcggactaggggacccgggccggcccccaagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgttttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatnttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaaaaaaaaaaaacgacacaccacaaaaacaaacgtgtgttgcgggcgcgcccttcggccccctggagaaaagagctttctcaaagaacccatttccgttgtgggcgcggcggggcccccagatgatgtatagcggtgacaccggggtccaaaacgagtgtccccaaaagaaaaaccgcgggcaagaaaaggtcgcgggtttcctcacccaattaaaaaaaggcgcgggggacaaaccacgctgtcgtgaacaatcccgag

SEQ ID NO: 444128 - DNA, 4272 bp, Homo sapiens
  misc_feature (1642)..(1642): n is a, c, g, or t
cttcctgcttctgcccctcaccaagaccctccaccagcaaaaaggtcatgactttctgaaggctcagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgttttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatnttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaa

SEQ ID NO: 444129 - DNA, 671 bp, Homo sapiens
  misc_feature (24)..(24): n is a, c, g, or t
gcggcccctactactactaaattnccggccgcgtcgacgtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctacaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaggggggggggggaaaacgggggggggagcccaacattttcgacgacacgccaccattttgtgtgtataaaaagagggggcccccatagaggagaggagcctttaacaacaaaagaagaggaggaggacggcggcctgaaaacaaacaacgacgcccaagcgaggagaaaaccactgaagtgcgagactgtgtggaaggaaaagagcccccactgccgggggggagaaacaatgtgcgcaaacacacacccaggaaataaagagcgcgagggaaaaaaacaacgggggggaaaagag

SEQ ID NO: 444130 - DNA, 773 bp, Homo sapiens
  misc_feature (6)..(6): n is a, c, g, or t
  misc_feature (15)..(15): n is a, c, g, or t
  misc_feature (39)..(39): n is a, c, g, or t
  misc_feature (41)..(41): n is a, c, g, or t
  misc_feature (87)..(87): n is a, c, g, or t
ccagcntttaaatgngctgattcccaccaccccaactancnctaagttaatttcagctcctctgtggacatataagggctcccctgntggaccataggcaaataacctggcaaacttagttctggtgatttcttgatggttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatggtacatctttttctttcaatttgcatacaatggaaaaaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444131 - DNA, 314 bp, Homo sapiens
atttgtcagttgtacgggtgaccctataatccacaacgtgtttaggctttttccctcaggacagggtgctgatatgtatcatgggatcctgccttatgtccacgccaatctagcatcatgggtgttttgatttgatgtgtgcccaatttgaacaagggttgattgacacctgtaaaatttgttgaaacgttcctcttaaaaggaaatatagtaatcttatgtatttttttgtgtgaagtgtttttctagcatttataagtgaaagctggcaggggtggtagttgggctcataatttattaaagtggtaatttag

SEQ ID NO: 444132 - DNA, 589 bp, Homo sapiens
aggatcccccctccgtcctggacagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaaccta

SEQ ID NO: 444133 - DNA, 466 bp, Homo sapiens
tcatttctctggtgaaaactgctgccaaaaccacttgttaaaaattgtacagagcctgtagaaaatatagaagattcattggatgttggcctagttctgtgtggaagactagtgattttgttgtttttagataactaaatcgacaacaaatcacagtctgccatatggcacaggccatgcctctacaggacaaatgattggtgctgtaaaatgcagcatttcacaccttactagcattctttgtcttttctaccaaatattaacaactttcaattccgttttcttaattctgttctactaatgtccgatttacttacaactcctaaatatttcttgaactgttctctatttttccattttaatttgggtttcctggatgaagactcttggaacaaatgtttatgaaagttatttgtaagttgaagttaggagggaaactgcctgtgagaggaggaaaagggggata

SEQ ID NO: 444134 - DNA, 2851 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444135 - DNA, 3057 bp, Homo sapiens
  misc_feature (3038)..(3038): n is a, c, g, or t
  misc_feature (3040)..(3040): n is a, c, g, or t
  misc_feature (3044)..(3044): n is a, c, g, or t
  misc_feature (3047)..(3047): n is a, c, g, or t
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccaatttgaacaagggttgattgacacctgtaaaatttgttgaaacgttcctcttaaaaggaaatatagtaatcttatgtaaaaaaaaaaaaaaaaaaaaaaaaaaaaaaaaaaaaaaaaaaaaaaaaaaaaaaaaaaaaaaaaaaaaaaaaaaaaaggggggggcgcggccnanaatnccncccggggggg

SEQ ID NO: 444136 - DNA, 4140 bp, Homo sapiens
  misc_feature (2959)..(2959): n is a, c, g, or t
  misc_feature (2996)..(2996): n is a, c, g, or t
  misc_feature (3031)..(3031): n is a, c, g, or t
  misc_feature (3126)..(3126): n is a, c, g, or t
  misc_feature (3151)..(3151): n is a, c, g, or t
  misc_feature (3184)..(3184): n is a, c, g, or t
  misc_feature (3224)..(3224): n is a, c, g, or t
  misc_feature (4140)..(4140): n is a, c, g, or t
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctacaaaaaaaaaaaacaaaaaaaaacagcggtggaaaccttccctaacactgaaaccaatggtgaatttggtaaacgccctgcagaagatatggaagaggaacaagcatntaaaagatctagaaacactgatgagatggttgaattncgcattctgcttcagagcaagaatgctggggcagngattggaaaaggaggcaagaatattaaggctctccgtacagactacaatgccagtgtttcagtcccagacagcagtggccccgagcgcatattgngtatcagtgctgatattgaaacaantggagaaattctgaagaaaatcatccctacctnggaagagggcctgcagttgccatcacccactgcaaccagncagctcccgctcgaatctgatgctgtggaatgcttaaattaccaaacactataaaggaagtgactttgactgcgagttgaggctgttgattcatcagagtctagcaggaggaattattggggtcaaaggtgctaaaatcaaagaacttcgagagaacactcaaaccaccatcaagcttatccaggaatgctgtcctcattccactgacagagttgtcttatcggaggaaaatccgatagggtggtagagtgcataaagatcatccttgatcttatatctgagtctcccatcaaaggacgtgcacaggcttattgatcccaatttttacgatgagacctatgattatggtggttataccaagaagtagatgacagtcgcggacgcccaggggggataacccatgcggaggaaagacgctggataggacaagaatgcctcatgagcggggtgggggtccaatgactcaatctagaaacagattatagaagaactgagtcgtcgtaaggaccaaacatgcacacttagtcccgggaagaatgaggccagagatgggatgcaagagataggaacacgaccatataccctcagaccgacaacacgacaaacaagagggtatgaacacaccaagggccactacagtacgaacaaggcgcccaaccaggaacaaccgaccaaaacgcacgaaagcaggacacaacgagccacacacaaaccacgggagacatgcaacacacaacgccgccacacaacagacagcagtaaagaacaaacaaggaaacgaaacaaaacaacacagccagcttcgggacaaacgatcgacaccagaagcaaaaacaagacaacagagcgagaaggacgaacagaaaacgagacacgaaccgacacgcagcaccaagactagctagcgaagaagccn

SEQ ID NO: 444137 - DNA, 3153 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctacaaaaaaaaaaaacaaaaaaacaaaaaaaaatgttggtggggcgcgccctgggacccgaagaaaagtattttctagaaaccattgcgtgggggcgcgccgcggggcgccgatatggggcaatgtgtaaacgcgggccaaacgggtggcccaaagaagaaacccgcgggccacagacatgggggggttttctcccccattaaaaaaaccccggggggacaaccaggggtctcttggacaacacagaaggggttcgaggggcaaccggggttctcacaggggtccgggaggacaaataaatacc

SEQ ID NO: 444138 - DNA, 2120 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaaccta

SEQ ID NO: 444139 - DNA, 3258 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagattgtaagtatctttaatactaccaggaacattttatcacttttatgattattcctcctttctgtatattttttaattcagaaggttttaacaaaaatacacatttaggattgaggttatgttaatgggctttagtgagctgggttttcagctgtttgagtcttgtcaagtgatcagtgctattaataaaagtagttaagtaggttttgagcccttaactaactaagggaaacattagtaagtgtgacataaatacattataactcaaaccttgacaggtttagggagcgttagatcatcagttaagattctgaatgaataaaattaataacttcatgctccttgaaaatacaggtagtaaatgttaaaagtatatcgtaaacacatacttttaaaaaatcttttcagtttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444140 - DNA, 2060 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaaccta

SEQ ID NO: 444141 - DNA, 2770 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444142 - DNA, 2689 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444143 - DNA, 2629 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444144 - DNA, 2490 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaaccatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444145 - DNA, 2231 bp, Homo sapiens
  misc_feature (2212)..(2212): n is a, c, g, or t
  misc_feature (2214)..(2214): n is a, c, g, or t
  misc_feature (2218)..(2218): n is a, c, g, or t
  misc_feature (2221)..(2221): n is a, c, g, or t
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctaaaaaaaaaaaaaaaaaaaaaaaaaaaaaaaaaaaaaaaaaaaaaaaaaaaaaaaaaaaaaaaaaaaaaaaaaaaaaggggggggcgcggccnanaatnccncccggggggg

SEQ ID NO: 444146 - DNA, 2196 bp, Homo sapiens
  misc_feature (2170)..(2171): n is a, c, g, or t
  misc_feature (2175)..(2175): n is a, c, g, or t
  misc_feature (2177)..(2177): n is a, c, g, or t
  misc_feature (2192)..(2192): n is a, c, g, or t
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctaaaaaaaaaaaaaaaaaaaaaaaaaaaaaaaaaaaaagagggggggggggnnaaanantttccccgggggggnccca

SEQ ID NO: 444147 - DNA, 2122 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtcattttttccggaccgttttccggattttatttctttttgtaaggaacccttttttaattctaaaaaaaaatgtgtgtcggaaaaaaaaaa

SEQ ID NO: 444148 - DNA, 1713 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatcttttttttttttttttggaatggtttttttctttggaccacaattcttgctctgtggcccagg

SEQ ID NO: 444149 - DNA, 2205 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagattgtaagtatctttaatactaccaggaacattttatcacttttatgattattcctcctttctgtatattttttaattcagaaggttttaacaaaaatacacatttaggattgaggttatgttaatgggctttagtgagctgggttttcagctgtttgagtcttgtcaagtgatcagtgctattaataaaagtagttaagtaggttttgagcccttaactaactaagggaaacattagtaagtgtgacataaatacattataactcaaaccttgacaggtttagggagcgttagatcatcagttaagattctgaatgaataaaattaataacttcatgctccttgaaaatacaggtagtaaatgttaaaagtatatcgtaaacacatacttttaaaaaatcttttcagtttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtggaggaactggtttcaagaagcaggaactggggtcagcggattaaacaaatccgtcatgattcgggagcttcgatcaaaattgatgagcctttagaaggatccgaagatcggatcattaccattacaggaacacaggaccagatacagaatgcacagtatttgctgcagaactggaggaactggtttcaagaagcaggaactgggggga

SEQ ID NO: 444150 - DNA, 1460 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatatatggctgatctaatattgcatagatgaaacaggggcgagt

SEQ ID NO: 444151 - DNA, 1253 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctccatccaaaggatcgtgcacacgactatgatccaataaacgatgaaagctatgcatatgcgtggttgcacacagactgtctgaggaccgtccgggagcccgagggcatcacaacgggagagaagacggagatcagagacgaagaaaccgaacaggagagccaggcgaagacacaaagcgacgcacagaccgaacgcccacgagaggacgccgcccacacagacgaagacaggcgagcacaacgaagaccaggcaaacgacaaaaggacaccagcaccaacacaaaccaacaaaaagaagcgacagcccaacgaccagcaccgcgaacaacgaacacagacatacaacgaaaaaaggcaaaaaacccgagaagaaaaca

SEQ ID NO: 444152 - DNA, 762 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtcacttcctttatagtgttggtaatttaaccattcctcggccgc

SEQ ID NO: 444153 - DNA, 1539 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagacgtaagtattaagagtttaaactactacacgagcagcttcagtttatatgtctatagaaatttaaagatttacatcctagaaatcatttcatagtttagctacaaagacatttgtaataatttattattacagaattgatttcgaagttatccattcctgttttaacaaaagcccagattgagcagggtgggggggtggtttcttttaaacctcttcacattttaataagagtccaccaaattattcacttcatcaagcaagataacatcttaattagaaatagcgacaaagtgtaaaaatccttgattgcaccatttcctgtgtgtgaatcaattacagtattactgaaaaccattgcaggtggctggttaaatccagaaaaatttttttgttttctttgggaagaaaaatgtccatctgttctttaacagcttgcacatggagcacaaagaatttaatgttgaggttgcatgatttaaatatgggtaaagaatagagtaggcacttaatcttataattgggaaactgttcgtcaatgcctatgatttgtttgagtcttcattttacagtgggttgactcttgtgattagacacattaaatgttggcagtgccagaagtgagcacatttataggacttggctacaccaaaatttctaaattttttttctcatagtgtacacatttcttaatgtttttcttgctaaaaatgaggcaaataactttgtgtcgagtacttatttgacagtatttcatttctctcttggtcgcagatctttgtatgttcctcttgattactgtaaactgaacttgaaaatttgtttaaaattttacaaacttgcctgttaggatctaggaatgcatttcaaaacctccagaaaaccaaaccagtcttattagttagggtttttggtggtgtgggaatttttgttttgtcttttataaacctctctcctcttaatccagatgttctgtataattatctgggttattaatttccccatttcctcaagaatttcagtaaactttgagtcaggttttgtgtctaccctcatgagccagcctgctactgaaacatcgtttgtttttcttaaaaaaaaa

SEQ ID NO: 444154 - DNA, 719 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcggtatgtcccaacagtttatgcctcactgcctgattagaaagagagaaatgtattttattacctgccttttatataattaaatagtatcccctttagacggtgtattgtttttcaagtttctgtcttattttccccattaagtctttttgtcactgaacttttaccgtgagttgcccacccaaacgatccactaattttatttcgatggaaggagcacagcttcaagtgttgcata

SEQ ID NO: 444155 - DNA, 443 bp, Homo sapiens
tcggcgctcggctccgcctagtagcacgtagtcgccattacgcgggccgccatttcctgtcggatccgggtgaggagaggtgcggtgcttctgctgtcgactttcgctttttcccgtcctgttacccggctgtttttgatctcggtgccgggaggcggggaggggagggcgcgttggcgctcggccagtggagcacatacttagcggatttttgaggcctggggactagtgactgcaggacccgaagggtgaacggcaagcggcaacgttattcttacagataagccctgctgtttttgcttaaactttcttatccaactcttctcccaccacacctcagaaattgcgtgctgggccggaaggatgtcgtttcagttgtcgttaggagagcaataagtcgaccaacggtatgggagaatgggaggcataaatgtgcctcgctt

SEQ ID NO: 444156 - DNA, 226 bp, Homo sapiens
acaatgcgggttcatgttaatgtttttatctctaacaggttggtttcagtgctgatgaaacttgggactctgcaatagatacatggagcccatcagaatggcagatggcttatgaaccacagggtggctccggatatgtgttcgtgtgtatatcagtgataatttaagatgcttacctgctctccagtaagttttttattcccctgaggatacttactgaaaatag

SEQ ID NO: 444157 - DNA, 2791 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444158 - DNA, 2946 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccaatttgaacaagggttgattgacacctgtaaaatttgttgaaacgttcctcttaaaaggaaatatagtaatcttatgta

SEQ ID NO: 444159 - DNA, 4031 bp, Homo sapiens
  misc_feature (2850)..(2850): n is a, c, g, or t
  misc_feature (2887)..(2887): n is a, c, g, or t
  misc_feature (2922)..(2922): n is a, c, g, or t
  misc_feature (3017)..(3017): n is a, c, g, or t
  misc_feature (3042)..(3042): n is a, c, g, or t
  misc_feature (3075)..(3075): n is a, c, g, or t
  misc_feature (3115)..(3115): n is a, c, g, or t
  misc_feature (4031)..(4031): n is a, c, g, or t
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattccaaaaaaaaaaaacaaaaaaaaacagcggtggaaaccttccctaacactgaaaccaatggtgaatttggtaaacgccctgcagaagatatggaagaggaacaagcatntaaaagatctagaaacactgatgagatggttgaattncgcattctgcttcagagcaagaatgctggggcagngattggaaaaggaggcaagaatattaaggctctccgtacagactacaatgccagtgtttcagtcccagacagcagtggccccgagcgcatattgngtatcagtgctgatattgaaacaantggagaaattctgaagaaaatcatccctacctnggaagagggcctgcagttgccatcacccactgcaaccagncagctcccgctcgaatctgatgctgtggaatgcttaaattaccaaacactataaaggaagtgactttgactgcgagttgaggctgttgattcatcagagtctagcaggaggaattattggggtcaaaggtgctaaaatcaaagaacttcgagagaacactcaaaccaccatcaagcttatccaggaatgctgtcctcattccactgacagagttgtcttatcggaggaaaatccgatagggtggtagagtgcataaagatcatccttgatcttatatctgagtctcccatcaaaggacgtgcacaggcttattgatcccaatttttacgatgagacctatgattatggtggttataccaagaagtagatgacagtcgcggacgcccaggggggataacccatgcggaggaaagacgctggataggacaagaatgcctcatgagcggggtgggggtccaatgactcaatctagaaacagattatagaagaactgagtcgtcgtaaggaccaaacatgcacacttagtcccgggaagaatgaggccagagatgggatgcaagagataggaacacgaccatataccctcagaccgacaacacgacaaacaagagggtatgaacacaccaagggccactacagtacgaacaaggcgcccaaccaggaacaaccgaccaaaacgcacgaaagcaggacacaacgagccacacacaaaccacgggagacatgcaacacacaacgccgccacacaacagacagcagtaaagaacaaacaaggaaacgaaacaaaacaacacagccagcttcgggacaaacgatcgacaccagaagcaaaaacaagacaacagagcgagaaggacgaacagaaaacgagacacgaaccgacacgcagcaccaagactagctagcgaagaagccn

SEQ ID NO: 444160 - DNA, 3352 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaatgtatgtcatagtgccattgaaccccactgaagtatggagcctggcccataggatcgattatatttttaacatagtgtgcttttcccatctctatagaaaaaggcttaaaaacatgatacatgaatggtcttacaactcactgttgaccctgctccatgctgcagtgggaattaactacatttgcaaagtgctttgcagtcatttttattatggtgttatttgaatgttaataataattttgtggtaacagcgacatgctaaatggctgcagtgtgggtatggtgttgcaggacctgaaaataaaatagttttttaaggtggtgcagaatgtcctttttgggcctggctattgaggataataagcacataactggtaaagttattgaaatataaattcaggttgctcactgcaacagtatattattgttatgcttatagcagataagtgtgtattggggaattgttgatttgagactaaaattttataattctccctccacataccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444161 - DNA, 2797 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444162 - DNA, 2797 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggctgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444163 - DNA, 2606 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgcta

SEQ ID NO: 444164 - DNA, 2268 bp, Homo sapiens
  misc_feature (2242)..(2243): n is a, c, g, or t
  misc_feature (2247)..(2247): n is a, c, g, or t
  misc_feature (2249)..(2249): n is a, c, g, or t
  misc_feature (2264)..(2264): n is a, c, g, or t
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaaaaaaaaaaaaaaaaaaaaaaaaaaaaaaaaaaaaaaaaaaaaaaaaaaaaaaaaaaaaaaaaaaaaaaagggggggggggnnaaanantttccccgggggggnccca

SEQ ID NO: 444165 - DNA, 2171 bp, Homo sapiens
  misc_feature (2152)..(2152): n is a, c, g, or t
  misc_feature (2154)..(2154): n is a, c, g, or t
  misc_feature (2158)..(2158): n is a, c, g, or t
  misc_feature (2161)..(2161): n is a, c, g, or t
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctaaaaaaaaaaaaaaaaaaaaaaaaaaaaaaaaaaaaaaaaaaaaaaaaaaaaaaaaaaaaaaaaaaaaaaaaaaaaaggggggggcgcggccnanaatnccncccggggggg

SEQ ID NO: 444166 - DNA, 1747 bp, Homo sapiens
  misc_feature (1731)..(1731): n is a, c, g, or t
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgggaggagangaaggtacgagcatga

SEQ ID NO: 444167 - DNA, 1777 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagggtcagtttaagtttagctttgtgttagcttatacatactaaaacctttaaaaagcttttcttctcaattgatttttttcttttagaagccatggtgtctcaaccttttggggacctaacttctaaacattctaatagtttgccttaatttttcttctgctttcttactaaaaacgaagacattcaata

SEQ ID NO: 444168 - DNA, 1099 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgatactggggggccaatgttggtg

SEQ ID NO: 444169 - DNA, 905 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcgggacgtggacat

SEQ ID NO: 444170 - DNA, 784 bp, Homo sapiens
gcgggggaggggagcctgcgctcgttttctgtctagctccgaccggctgaggcggcgcggcagcggagggacggcagtctcgcgcggtgaggagccgggttgggggagcggctcgtggaggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtaaggctacagcatcctcatcctccacgctgttggagacggtgctggtgatgaagggcttgggtgg

SEQ ID NO: 444171 - DNA, 1013 bp, Homo sapiens
cgtggcacggctccagcgtcgcgctctcgaattcatttgctttccttaacgagagaaggttccagatgagggctgaaccctcttcgccccgcccacggccctgaacgctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444172 - DNA, 835 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444173 - DNA, 1235 bp, Homo sapiens
gagggaactggtaatagaatttattcaaatgtgccttaatataggcgctggggcttgcccatggtgctcttgatatataaggcccggacattctgccagtttttcttgagcaatgacaccaagaagttgacagccaggtgaatgttatacacaagctcatcgtctgtcatcttcacgtgaccaacagctacagccagacataacaccttcttcatttggaacttgattgtggacttcacctcatccactttggccaccatgttttcgttgtgtgtgagcagggaagggaactttcctgccttatttaaacctgggccgaggattcgtggaatctgcttgatcagagactctgaggccaaaacgcatcatacttcttggccagcttcttgaccagttttttattcttgttgagttttttcagcgcctcgatgtccatgtgggggatatccacggccttagcctcgtcaagacccacacccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444174 - DNA, 1039 bp, Homo sapiens
ggctggaggacaaaacttaggctaggtacgaggctgggtgttaatcggccgaggccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctacccgaagacaccacaacaaaactaacaccccacaccccacaacccacacagcacaaaagggacgccccaaacaactccccaggcgacacacaagcacagacaaagacaagggcgacaaggaacacaaaccacacagagcggacacaaccccgaagaaacacagaggagcgcgaggcgccccggcgcaccagaacccacagaacggcgacaccacgtcaggcaaccc

SEQ ID NO: 444175 - DNA, 677 bp, Homo sapiens
tgtggccccaggtggtccttccaggttggggaccgaataccacccttggccagccttggtttgcacggttccgatgagtgtccaagtgttagcgcaacagttggcagtttaagtggccccctgcaccggcttcaataaaaggccccagtgtcagatccgcttataacgagggctaagctgttaatcacaagaggggcatggagatcggcgcattcggaccggtggggtgtgtcatggatgtctaacactttcgcccgggacagcgttcggtcaaagaccaaggatgcctgttgcagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444176 - DNA, 1826 bp, Homo sapiens
cgtggcacggctccagcgtcgcgctctcgaattcatttgctttccttaacgagagaaggttccagatgagggctgaaccctcttcgccccgcccacggccctgaacgctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacctgccccccggtgtggactcgccatccgcaatgtttctcatcgcttcacgctgtcctccatgaggtggtcgagcatcgtgaccgatggatggccgcgcacgatgccacaaaagcttgagcacacgcctagtccgatacgagatccactcattctccaaggtctagcctatcgcagctcagcagggcaccgacgcttgggcggccgcagaaaggcctggcagatacatcctgaagtgaggacgtgcgcagcacgagatggtaaagatgccctttagcccccgggggaatgcgtcgcgactcgccctgtcttagcacgggcacaacctaggtgtaggtgcccttcgcgcccacgggccaggcatggtggttgtaacattgggtggagtaacaaattttttctcgtcttgataagcgtggtctaaagcgttaaagccggtttcaacaaacgtacattaggccaacggacccatggcaggggaattgacgaaatttccacgaagagtgagtggagcggcggacgtgaaaaatgggtattccgctcaagccgtgtcgggcgcaaaataaccttaaagaagcgcttgtcctccaagtgttttacgggatttgggcccccgttgtggagcccctcctgaatgaattgaggcgcgatccgattaactagaagaaagacttggcgtggcgaaagggggccgagggaatgatgaccacgggaagtctcgtctttggcgctttcgtatacccacacaggggtttatcccttgccgcaatgaaaaccgtgggagagggggagaaaccctaatattcttggccaattttcgagtttcccacctcctggaggtttggagtaaaccacgaattttcccgtattaaagagggggaagcattttttatcaatggacttctaaaaaagaagcggaggagataagataataacgataggtatggatttaggaaccaaggggataaaagttcgagggtgaaaaaacactttgcgttcgagaggaaattcagagccgaattggaagcgcgtttgcagaattaagattaaggttggcaacaaggagagagtctaatagattggatatgggaaggataatagttttattcctaaggcaagggggta

SEQ ID NO: 444177 - DNA, 785 bp, Homo sapiens
cggacgcgtgggtcgacccacgcgtccccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444178 - DNA, 688 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444179 - DNA, 999 bp, Homo sapiens
  misc_feature (906)..(906): n is a, c, g, or t
  misc_feature (916)..(916): n is a, c, g, or t
  misc_feature (919)..(919): n is a, c, g, or t
  misc_feature (922)..(923): n is a, c, g, or t
  misc_feature (932)..(932): n is a, c, g, or t
  misc_feature (935)..(938): n is a, c, g, or t
  misc_feature (941)..(942): n is a, c, g, or t
  misc_feature (946)..(946): n is a, c, g, or t
  misc_feature (952)..(952): n is a, c, g, or t
  misc_feature (954)..(954): n is a, c, g, or t
  misc_feature (960)..(960): n is a, c, g, or t
  misc_feature (967)..(967): n is a, c, g, or t
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctaaaaaaaaacacaaaaaaaaataaaaaaaaaaaaaaaaaactgnggttttttgnggnggnnaaaaaatanaannnnggnnaatntttccncncctttntaaaggnaaacgggcccaaagagggtaaataaagagaga

SEQ ID NO: 444180 - DNA, 1355 bp, Homo sapiens
  misc_feature (1353)..(1353): n is a, c, g, or t
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctcctgtcactggcccaggcctggtgtttgtggaaggaagcctcaggcacctgccatttgctggctttcaggagtcatctttgctcaggcccgtgctgggccatgtgggtacactggtgtaggttgctggacacaggctgactcacatccataaagacagaggtcttagggccgggcgcagtggctcatacctacaatcccagcactttggggggttgaagcaggaggagtgcttgaagccaagagttctagaccagcctggacaacatagtaagactgtctctaaaaaataaaaattaggcagggtggtactgcacgcctgtagtcccagctactcaggaggctgaggcaggaggatcgcttgagcccaggagttgtgaagggtacagtgagctaacatcgtgccattgcactccagcctgggcaacagaacaagatcctgtctcaaaacaaccaaaagcccagagagaaagagtgagaccccatctttaanag

SEQ ID NO: 444181 - DNA, 1009 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctaaaaaaaaaaaaaaaaaactcgaaaagtctgagtaaagctgttttttgtattttatatttgcttctgccattttactgtcactaattaatgtttagttcttatatttgttaactgatttcggtgtcttgaatatatttttttaaatt

SEQ ID NO: 444182 - DNA, 1007 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctaaaaaaaaacaaagcacacaacagaaaaaaaaaaaaaaaccgggggccatattaggcgggggaaaacgaggttaaaaccacgtgttacattttcccgaccacttttttaaaaggggaatggcgcgccaaaaggggaaaatgaacg

SEQ ID NO: 444183 - DNA, 1202 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctaaaaaaacaacaaaaaaaaaaaaaaccaaaacacaacaaaaaaacaaacaaagggtgagaggacagaaaagacaacacgagagaggacacaaaagacagagagagatacaaaaaaaaagacaaacagagggagacagaaagaaagaagagaaaaaaacagcacaaagcgcgagaacaacaaggagagaaaaacagaaaaaaaaacaaagcacacaacagaaaaaaaaaaaaaaaccgggggccatattaggcgggggaaaacgaggttaaaaccacgtgttacattttcccgaccacttttttaaaaggggaatggcgcgccaaaaggggaaaatgaacg

SEQ ID NO: 444184 - DNA, 1560 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444185 - DNA, 1486 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444186 - DNA, 1510 bp, Homo sapiens
cggacgcgtgggtcgacccacgcgtccccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444187 - DNA, 798 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccaaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444188 - DNA, 1723 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacaccgtgagtcctggcgccaggtcggggtgggtgggtggcgtgggggtattgttaatgttttttaatgttatgatgtactggttggagactgtatattgttatattagtaactcttgtcctctcctgctccgctcagtactttctcatccgcgtcctccccttttctcccttagtcctcggtacactgatctctccgtcgatcttcccctcctagctggtccatttccttccatcgttcctcccacttctctacgctctagcggcatcagccccagccactcccttcccgctaccgtctcgtttcttcatccgcatatcacttatcctcgcaccgaccgcttctgcagtatctcctactccatcgtctgcctctcgctctcggtgaactctggctagctccatttgtctccacatgcttgccctgcgtggagtctgacgtccatagacctttccttccctttccttctcttttgtc

SEQ ID NO: 444189 - DNA, 1675 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacctgccccccggtgtggactcgccatccgcaatgtttctcatcgcttcacgctgtcctccatgaggtggtcgagcatcgtgaccgatggatggccgcgcacgatgccacaaaagcttgagcacacgcctagtccgatacgagatccactcattctccaaggtctagcctatcgcagctcagcagggcaccgacgcttgggcggccgcagaaaggcctggcagatacatcctgaagtgaggacgtgcgcagcacgagatggtaaagatgccctttagcccccgggggaatgcgtcgcgactcgccctgtcttagcacgggcacaacctaggtgtaggtgcccttcgcgcccacgggccaggcatggtggttgtaacattgggtggagtaacaaattttttctcgtcttgataagcgtggtctaaagcgttaaagccggtttcaacaaacgtacattaggccaacggacccatggcaggggaattgacgaaatttccacgaagagtgagtggagcggcggacgtgaaaaatgggtattccgctcaagccgtgtcgggcgcaaaataaccttaaagaagcgcttgtcctccaagtgttttacgggatttgggcccccgttgtggagcccctcctgaatgaattgaggcgcgatccgattaactagaagaaagacttggcgtggcgaaagggggccgagggaatgatgaccacgggaagtctcgtctttggcgctttcgtatacccacacaggggtttatcccttgccgcaatgaaaaccgtgggagagggggagaaaccctaatattcttggccaattttcgagtttcccacctcctggaggtttggagtaaaccacgaattttcccgtattaaagagggggaagcattttttatcaatggacttctaaaaaagaagcggaggagataagataataacgataggtatggatttaggaaccaaggggataaaagttcgagggtgaaaaaacactttgcgttcgagaggaaattcagagccgaattggaagcgcgtttgcagaattaagattaaggttggcaacaaggagagagtctaatagattggatatgggaaggataatagttttattcctaaggcaagggggta

SEQ ID NO: 444190 - DNA, 803 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacactctccaccagccatccgttggtctcacccggcaactcagcagcggggatgtcggagatccggcacactgccggagcgagggcgcgtgtccctggatgtcaaccacttcgaccgcggacgacgctgacggtcaagaccaaggatggcgtggcgcagatcaccggccaagagcccgaggcagcgcgaggacgagcaatggctacgatctgcccggagctccgacagcggcaaacacaggctggcgcccacggg

SEQ ID NO: 444191 - DNA, 565 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccgcccacccctgctgccgccactggctgtgcctcccccgccacctgtgtgttcttttgatacatttatcttctgtttttctcaaataaagttcaaagcaaccacct

SEQ ID NO: 444192 - DNA, 385 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggcgctgtgcctcccccgccacctgtgtgttcttttgatacatttatcttctgtttttctcaaataaagttcaaagcaaccacct

SEQ ID NO: 444193 - DNA, 414 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444194 - DNA, 683 bp, Homo sapiens
tggggggggctttgaactttatttgagaaaaacagaagataaatgtatcaaaagaacacacaggtggcgggggaggcacagccagtggcggcagcaggggggggcatccgggctaaggctttacttggcggcagtctcatcggattttgcagcccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444195 - DNA, 812 bp, Homo sapiens
ggctggaggacaaaacttaggctaggtacgaggctgggtgttaatcggccgaggccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444196 - DNA, 982 bp, Homo sapiens
taggaccaggacggccggcaggaaaacaggaaactccagtcccagagcagcgggcagaagaccgtccccaggatgtgggcacttctcgccagagggtcctgagcctggggcgcactcttctggtttgggagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgtgcgacactggctgtgcttccccggcactgtgtgtcctttggaaccctgtagtcctcggagcctcacataaaggtcaaggaccaagaaaacgccacaacgacaacaag

SEQ ID NO: 444197 - DNA, 862 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444198 - DNA, 710 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444199 - DNA, 903 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctaaaaaaccaccacaccgactaccaatacaacacacaagcgc

SEQ ID NO: 444200 - DNA, 1216 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctaaaaaaaaaaaaaaaaaactggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattcttaaaaaaaaaaa

SEQ ID NO: 444201 - DNA, 1124 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctaaaaaaaaaaaaaatcgtgcatctagcggggcggaacagagtacgaaagggctggcaaacggtcccgcaccgttggtgtaccaggggaaatgcggaccccaaaggaggggaaaattgaaagcggaataatactatagaatacgaagacaagagaagaaacgaaatagagaacaagaaactaaacaaacaagataatagacagacaaagaaaaacaatacatcataaacaatgatatactcgtacgaagcgaataaacgagaa

SEQ ID NO: 444202 - DNA, 1089 bp, Homo sapiens
ggctggaggacaaaacttaggctaggtacgaggctgggtgttaatcggccgagggcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctacccgaagacaccacaacaaaactaacaccccacaccccacaacccacacagcacaaaagggacgccccaaacaactccccaggcgacacacaagcacagacaaagacaagggcgacaaggaacacaaaccacacagagcggacacaaccccgaagaaacacagaggagcgcgaggcgccccggcgcaccagaacccacagaacggcgacaccacgtcaggcaaccc

SEQ ID NO: 444203 - DNA, 813 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatggctgtgcctcccccgccacctgtgtgttcttttgatacatttatcttctgtttttctcaaataaagttcaaagcaaccacct

SEQ ID NO: 444204 - DNA, 1679 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacaccgtgagtcctggcgccaggtcggggtgggtgggtggcgtgggggtggggtcagggaagagggcacagggacccacccggtgtgtaatgtaacgcttgcctttcctctctgcacgtccaggctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444205 - DNA, 2033 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacaccgtgagtcctggcgccaggtcggggtgggtgggtggcgtgggggtggggtcagggaagagggcacagggacccacccggtgtgtaatgtaacgcttgcctttcctctctgcacgtccaggctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctaaaaaaaaaaaaaaaaaactggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattcttaaaaaaaaaaa

SEQ ID NO: 444206 - DNA, 667 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444207 - DNA, 672 bp, Homo sapiens
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaagtgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacct

SEQ ID NO: 444208 - DNA, 942 bp, Homo sapiens
  misc_feature (495)..(495): n is a, c, g, or t
cggacgcgtgggtcgacccacgcgtccgcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggctggcagcgctagcagacagagcgataaagcaagccaaactcaagtaagtagcaggattatccgagatgaatcgcggacaacactatgacggacctgcgatagggcagtcgtcagtcacccgctgtgagtagtccaaacacaagtcatcgcccccgggaaacgacgactcgagccgcatgcaagcatactaangcgagtgcgctcagaggtatggacgaatgcaccctggcatagggcagacgatgtgaggccagcgaggaccgtagcgattggcgtacgaatcatcgcgcggatgaccgttacgcacaggaaagatcagcgactggctccgcgctcgagatgatggagcacccagccaatggggtcctccttcccggtacaacttggaggaggcaacaactggacagtgagaggacgccaccatgacagcaagactagctaccgcagtgccggaccgagactcaacgcatgcacagatcagcctctcgaggtgatgggccaacgctggggggcgccagaaagcatgcaaaatcgcgaggagcctgcacgccaagataaagaccttaggcccgtaatgcgcaacacgtcggcgatgaccaagggctgaggcatccctacaacccgggaggtctcttgaac

SEQ ID NO: 444209 - DNA, 203 bp, Homo sapiens
  misc_feature (2)..(2): n is a, c, g, or t
cngcgtccgcccatgagaggagagggccctctctacctaacttgatacaactccagggagctgtcaggagagctcgtgtcgcccgagcgctacgcgctaaatgcactgatttcataagtatgtggaatccttttccttttgaatctgtatatcatatataagactgaatctacttaataaacactgaacaacaaaccgaaaac

SEQ ID NO: 444210 - DNA, 2919 bp, Homo sapiens
ctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactcacccttagcacagcacaacctccagtgcccaaggcctctcccacaccccagccatccacacatctggccccacctgctcagtactactcaacatttgaattcgtgtaaatatttatttttgtgtgtgaacaatactacaaagtaatcagtaagatcttttgcaaaaatgttaccccaggcaattatttgtgaaaatcttaatgttaaaacctggcagagacaatcgccaccctagaattcctggtatcagttacttaacgtgtcacttctcctcccagaggcagtacccaagctagacatgaaccgtttgcatttcttggcagacaggagtgagaaagactggggaaggggctccctccccctacccacacaaggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttacaaaatagtaaagtatttcaccagaataccagtttcaatccgtccatggtctgatttttatataatttagtggtgctttagaaactttgtttttgttgtttctgagctaaacagctcaatcctttttcgcctgtatctacctaagaccaatgtgaacctttgtatttttgctcctaattttggactcagtgaaagtgtactgtttacatgtacagatgcccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccgaaaac

SEQ ID NO: 444211 - DNA, 1362 bp, Homo sapiens
aacccctgtaaagacagattattaaccatcctcattgcccaaatgaaagaaaatcaggcctccaaagtggaaatgtaattaatggtgcaactggaatttgaatcccagatctgactataaaacaaaaaaaaagaccctgcttttgttccctactccctgctaccccactttgtttttgttgtttctgagctaaacagctcaatcctttttcgcctgtatctacctaagaccaatgtgaacctttgtatttttgctcctaattttggactcagtgaaagtgtactgtttacatgtacagatgcccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccgaaaac

SEQ ID NO: 444212 - DNA, 1519 bp, Homo sapiens
ctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagcaaaacaaaagaggcaccccgaccccattctacagaagccccagtccatggtcacctgtattctacctcacactccagcgtgggctttttccaggatgtgccctgagcctgttctgaacagctgtaaccccaactcccccacacaatgtgtctgcctgggaggtaagtaagtccagactgggtgtccaggagctggaacccagagagcgtcctgtccctaaccagccactgcagccctccagctctggccctcagctgcttgacaggacggactgctgggagatggcagccggttggcagggcccttgccctcacaccccgctgcccaggagccaggtctgaacttctgtgcacaggcctggcccctcagactcactcctgccaagaggggccacttcttcagggtgagccccggctatcaggcagccgtgagctccagggcgggctgcagctcccatccccttgcgccatgtttggagtaaagggatcagtggaagtggaggagccacttgggttctcctaagaccagcccttccggaggggccggtcctggaagaaacccataatccctgggtctgggggtggggggtaatggtgtggagatctatctgccttgcagctcgcccctgagtt

SEQ ID NO: 444213 - DNA, 4697 bp, Homo sapiens
ctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagcaaaacaaaagaggcaccccgaccccattctacagaagccccagtccatggtcacctgtattctacctcacactccagcgtgggctttttccaggatgtgccctgagcctgttctgaacagctgtaaccccaactcccccacacaatgtgtctgcctgggaggtaagtaagtccagactgggtgtccaggagctggaacccagagagcgtcctgtccctaaccagccactgcagccctccagctctggccctcagctgcttgacaggacggactgctgggagatggcagccggttggcagggcccttgccctcacaccccgctgcccaggagccaggtctgaacttctgtgcacaggcctggcccctcagactcactcctgccaagaggggccacttcttcagggtgagccccggctatcaggcagccgtgagctccagggcgggctgcagctcccatccccttgcgccatgtttggagtaaagggatcagtggaagtggaggagccacttgggttctcctaagaccagcccttccggaggggccggtcctggaagaaacccataatccctggagtgtgaaaaagggcaaaaagaaaaagctggcctggtttccttcctccctgattgattgattgataggcacttcctcttgctcagtgcaatacctaccagtgctgctaaaccagggactcgcccagacctcagcaggcccccagggcctctccgtgcaacactccgtagccatgacagcagctctctgctgcccgcccctgcccagagctggcagaagccctctgttgcctttcctccctcagagcagagaggccccaggggagccagggccgagtggatcctaggatggccacggagagccactcgctcccagaacaggcaccccttcccaaaccagcttttctgcagccaattgcctgttgcagctgtggccactgcctcccggcactgtggcagactccccccaaggagggatggggggggcaccagtgaggatgccccatcctgcctcaggtccagaactctgaaaggtagggtgcccaccccgtgcttacttccggcccctagaggttgggggtggtcgttatctctcaagtggcctccaataccccatccagccacaccacctctgccttccatctgaccaatccccaggcctctggtcagggccaggacacctgagactcacccttagcacagcacaacctccagtgcccaaggcctctcccacaccccagccatccacacatctggccccacctgctcagtactactcaacatttgaattcgtgtaaatatttatttttgtgtgtgaacaatactacaaagtaatcagtaagatcttttgcaaaaatgttaccccaggcaattatttgtgaaaatcttaatgttaaaacctggcagagacaatcgccaccctagaattcctggtatcagttacttaacgtgtcacttctcctcccagaggcagtacccaagctagacatgaaccgtttgcatttcttggcagacaggagtgagaaagactggggaaggggctccctccccctacccacacaaggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttacaaaatagtaaagtatttcaccagaataccagtttcaatccgtccatggtctgatttttatataatttagtggtgctttagaaactttgtttttgttgtttctgagctaaacagctcaatcctttttcgcctgtatctacctaagaccaatgtgaacctttgtatttttgctcctaattttggactcagtgaaagtgtactgtttacatgtacagatgcccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccgaaaac

SEQ ID NO: 444214 - DNA, 4642 bp, Homo sapiens
ctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagcaaaacaaaagaggcaccccgaccccattctacagaagccccagtccatggtcacctgtattctacctcacactccagcgtgggctttttccaggatgtgccctgagcctgttctgaacagctgtaaccccaactcccccacacaatgtgtctgcctgggaggtaagtaagtccagactgggtgtccaggagctggaacccagagagcgtcctgtccctaaccagccactgcagccctccagctctggccctcagctgcttgacaggacggactgctgggagatggcagccggttggcagggcccttgccctcacaccccgctgcccaggagccaggtctgaacttctgtgcacaggcctggcccctcagactcactcctgccaagaggggccacttcttcagggtgagccccggctatcaggcagccgtgagctccagggcgggctgcagctcccatccccttgcgccatgtttggagtaaagggatcagtggaagtggaggagccacttgggttctcctaagaccagcccttccggaggggccggtcctggaagaaacccataatccctggagtgtgaaaaagggcaaaaagaaaaagctggcctggtttccttcctccctgattgattgattgataggcacttcctcttgctcagtgcaatacctaccagtgctgctaaaccagggactcgcccagacctcagcaggcccccagggcctctccgtgcaacactccgtagccatgacagcagctctctgctgcccgcccctgcccagagctggcagaagccctctgttgcctttcctccctcagagcagagaggccccaggggagccagggccgagtggatcctaggatggccacggagagccactcgctcccagaacaggcaccccttcccaaaccagcttttctgcagccaattgcctgttgcagctgtggccactgcctcccggcactgtggcagactccccccaaggagggatggggggggcaccagtgaggatgccccatcctgcctcaggtccagaactctgaaaggtagggtgcccaccccgtgcttacttccggcccctagaggttgggggtggtcgttatctctcaagtggcctccaataccccatccagccacaccacctctgccttccatctgaccaatccccaggcctctggtcagggccaggacacctgagactcacccttagcacagcacaacctccagtgcccaaggcctctcccacaccccagccatccacacatctggccccacctgctcagtactactcaacatttgaattcgtgtaaatatttatttttgtgtgtgaacaatactacaaagtaatcagtaagatcttttgcaaaaatgttaccccaggcaattatttgtgaaaatcttaatgttaaaacctggcagagacaatcgccaccctagaattcctggtatcagttacttaacgtgtcacttctcctcccagaggcagtacccaagctagacatgaaccgtttgcatttcttggcagacaggagtgagaaagactggggaaggggctccctccccctacccacacaaggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttactttatataatttagtggtgctttagaaactttgtttttgttgtttctgagctaaacagctcaatcctttttcgcctgtatctacctaagaccaatgtgaacctttgtatttttgctcctaattttggactcagtgaaagtgtactgtttacatgtacagatgcccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccgaaaac

SEQ ID NO: 444215 - DNA, 401 bp, Homo sapiens
ctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacactttttttttttttttttttttttttttttttttttttgggaattccccccccgggggggctaaccccttttgtgaaaa

SEQ ID NO: 444216 - DNA, 470 bp, Homo sapiens
ctgtataagacactcttttctctgactccatcattaaccagggagatgatgcagtcctttacctgattatatctccacattcactcagaagttgggggaccagttgctgatgttttcactgtccttctggcccctccctcatgtctgcatttcctgtggatgggattttcctctctcatttcagtaaattccactatcttgatgatccgctttgtcttctgtcttccaggtctgtgaactccatcccagcagcatttaaatcatgcttatgtatttcagtcttaaagaaaacctcttgcttagccacaaattcctttctggcgactcccctttatttctaactatgcctcttcagtgtctcagaagagtggtctgccctctgcttccactcttacacttctctctcctcagtcttcaacccagtgtcatctgtcatcgttcctactacttcactgactttttttctcgca

SEQ ID NO: 444217 - DNA, 1010 bp, Homo sapiens
ggtgttacacacctgtggttccagctacttgggaggctgaggtgaaaggatctgggaagttgaggctgcagtgagactggggtgatcaggctggataatcctctctccctgttcccctcatttggctgctccagaccctgagaaacttctacctgtcccatgccagctgagggtgtctgaggagctgacatcaaccccatggatctcctgaactgtgctggaaggtagagacaggcagggaggcttcccaatgggtcaggagaacctgaccccacaaatcaactgatcttcaagagacaggatggagggagggatcattctagagaaccctgctccttgttcctccctgtggcaaaatctggcgccaggaagagtttgagtgtgtaggcgtgtgtgtgcaggtgtaagtgtgcaggcacgtgttgttgcaggtgtgtatgtacagccgtgtgtgcacgcatgtgtgtgcaggtgtatgtgtgtaggtgtgcatgtgcaggcatgtgtgtgtaggtgtgcatctgcaggtgtgtatgtacaagacgtgtgtacaggcatgtgtgtgcaggtgtgcatgtgcaaggtgtgtgtttgcaggcatgcatgtgcaggtgtgcgtgtgcaggcatgtgtgtgcaggtgtgtatgttcataatggccctaacgcccaagctggaaagttgtggatttacgggaatgagggcaagaaacacctggcccgcccagggcggaaaaccgcttaaaggcattcttaagccacaaataataacatgagcgctctgtgtcttaagggcgtgttcctgctgcagttaactaacccaacctattcctttaattcagcccatcccttcgtttcccataagggatacttttagttagttgaatatctctagaaacaatgctaatgactggtttgctgttaataaatatgtgggtaaatctctgtttggggctctcagctctgaaggctgtgagatccctgatttcccacttcacgcctctatattttt

SEQ ID NO: 444218 - DNA, 328 bp, Homo sapiens
gggtctagctgtgtggcccaggctggtctcaaactcctggccccattgatcctcctgcctcagcttcctgagtagctgggatgacaggcatcagccactgcacctgtcagattttttatttttagttgttatttaagtagttattgtgtggccacttgtccaattctgggttggaccggcaggagcctgtgctcatctgtccacagggaccacctcagtgtttggcattaccaggcagcggttgcgtccattgcctctactatccccttcttcgcattggagtagacttccctgggggcagcatgggaagaggttcctgctgcacctt

SEQ ID NO: 444219 - DNA, 382 bp, Homo sapiens
gggtctagctgtgtggcccaggctggtctcaaactcctggccccattgatcctcctgcctcagcttcctgagtagctgggatgacaggcatcagccactgcacctgtcagattttttatttttagttgttatttaagtagttataaaagaatgagcacctcagactggattttagaggagagccccctagactgtctctgtgtggccacttgtccaattctgggttggaccggcaggagcctgtgctcatctgtccacagggaccacctcagtgtttggcattaccaggcagcggttgcgtccattgcctctactatccccttcttcgcattggagtagacttccctgggggcagcatgggaagaggttcctgctgcacctt

SEQ ID NO: 444220 - DNA, 4461 bp, Homo sapiens
  misc_feature (2032)..(2032): n is a, c, g, or t
ccctttggaacctctccctgttttgaagccttcctgtttatccagtcaccccccttatccaccagtccccactctttcttatgtcactccgttgcctgcacatcctgctagcttggatccttttcagtcagtccagcaatctgttccacaagccacagcattgtcaaatcagcccgaggcctttgcagatcatccaccagcctcagttctctcccttgcatctccctgtcattctccatcttcttctttgccttcatctccttctacttccacatccttttcttcagcctgtatactgttttcttcctcctcatctattctttcctcttcttcgacttcctgttctacttctccatccttacctccttcatctatccctcttttttcctctcctttgcattcatcttcctctccaggtttgcctccaacttatttagcttttccctctccagtttctcctgtttcttcttcctttatgatttcctcttcctttccccctattcttcactctccttctgtttctacctccccatctccttttattcctatccaccccttcaatcctcctcattgggggaagaaagtagagaagagaagagaagaaagtggagtagagaagaaaggaatagagaagaaagttgagacacgacaactttaaagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaattttgtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagacnattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcaatgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttctctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattgaacctctttattaaacctctaacttactgataagatgtttatgaagtatggcatattttgatttttttaattgtaataaatattcttaaagttaccacatcccacaaaatggcccttggtggcagcaatagagcaaaggttacctttttgtatggtgaagggaggccttcctatggctgtacaattacatcgattcttccaaatttcatatttcatacatggcactttggcataccgaaaaaacatgaaatttttcattaaaatgccatgaatcaagccagggccgttggcttatgcctgtaatcccagcactttgcaggccgaggtagacagatggcttgagctcaggagttcgtgaccagcctgggcaaccctgtctctacaaaaaatacaaaaattaaccaggcatggtggcatgcacctgtagtcccagctacttggggtgctgaggcgggaggattacttgagcccaggaggattacttcaacctgggaggttgaggctgcagtgagctgtgtttcgccactgcacaccagcctgggtgacagtgtgagacccagcctcaaaa

SEQ ID NO: 444221 - DNA, 4122 bp, Homo sapiens
  misc_feature (20)..(20): n is a, c, g, or t
  misc_feature (1693)..(1693): n is a, c, g, or t
ctcacgctttatacttctcncagctattaacatattttctcctcttcttcagaattaaatttctcaaaaagaacgtttatattcaagtattcctgttcgtattccttaccctggtcttctctatagaatgcaatctggctgggagatgcttcactccactggaacaaggcttactgattcccaagggcctccttgcttctaaaaccaccgaagtgcttctgtctttatcttatttgtcctcttggcagcataaatgctggttttcttcctacttgtttggtctctcctcttcagtcttcatcatgtttttgtccctcaaacagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaattttgtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagacnattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcaatgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttctctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattgaacctctttattaaacctctaacttactgataagatgtttatgaagtatggcatattttgatttttttaattgtaataaatattcttaaagttaccacatcccacaaaatggcccttggtggcagcaatagagcaaaggttacctttttgtatggtgaagggaggccttcctatggctgtacaattacatcgattcttccaaatttcatatttcatacatggcactttggcataccgaaaaaacatgaaatttttcattaaaatgccatgaatcaagccagggccgttggcttatgcctgtaatcccagcactttgcaggccgaggtagacagatggcttgagctcaggagttcgtgaccagcctgggcaaccctgtctctacaaaaaatacaaaaattaaccaggcatggtggcatgcacctgtagtcccagctacttggggtgctgaggcgggaggattacttgagcccaggaggattacttcaacctgggaggttgaggctgcagtgagctgtgtttcgccactgcacaccagcctgggtgacagtgtgagacccagcctcaaaa

SEQ ID NO: 444222 - DNA, 1178 bp, Homo sapiens
tgtcaaggacgcgccgtcggttgttgtcaagatggcggctgcagggttgctgccgccccatctgctattgcccggcgaggtcgccgctgcctcagctgccatcgccgctacaggcaccagtgccgctgcgcgggagctagggctgtcgaggccaacccttccgcgcccgtgacgcggggcctgagagacggagtgtagggaggggccgagcaggaggaggaggaagccggagctgccatgagggaggttctgggggcgagcagacaggcggcgctgaagtgaaggatgctggcggggaggcccggaacccggagcgcggtcggggaactgggcactgaatcatcggacaacctcgacagagcccccctcggccctcgggagagcggcgggcatcaccgacctggctcttacctagatatgaaaatccatctggagaaaaatttagaagaagagcgccagatattactgcagcaacaaaaaatatgtcgaaatcgagcacgtaaatattttgtggagtcaaatcggagaaaaaaagcttttgaggagaaacgaaaagaacaggaagaaaaagaacaccaaattagagaacaaatacttcaacaaagaaaacagaagtttgaagaagttactgaaaaattccagcgtgcccatgttcctctttcacagcggaggaaagcagtttcccgaaaaccagttcctccattagaagaggccctcaaacaaattcaggaatccaacttaaaatcagaagtaaaccttcccttttcccgtagaccaacaataaactggagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaattttgtgatgaagttatcagataacccttcttggaccctcttaaggtatacaggtttaaggttagagcatgagaaatatttttacaccttataaggggttttccatacattcgccgaaaccactttcttaaacaggaaatggcaacactaacttgatggttgtgaagaaaaccggatttctccctt

SEQ ID NO: 444223 - DNA, 4592 bp, Homo sapiens
  misc_feature (2163)..(2163): n is a, c, g, or t
tgtcaaggacgcgccgtcggttgttgtcaagatggcggctgcagggttgctgccgccccatctgctattgcccggcgaggtcgccgctgcctcagctgccatcgccgctacaggcaccagtgccgctgcgcgggagctagggctgtcgaggccaacccttccgcgcccgtgacgcggggcctgagagacggagtgtagggaggggccgagcaggaggaggaggaagccggagctgccatgagggaggttctgggggcgagcagacaggcggcgctgaagtgaaggatgctggcggggaggcccggaacccggagcgcggtcggggaactgggcactgaatcatcggacaacctcgacagagcccccctcggccctcgggagagcggcgggcatcaccgacctggctcttacctagatatgaaaatccatctggagaaaaatttagaagaagagcgccagatattactgcagcaacaaaaaatatgtcgaaatcgagcacgtaaatattttgtggagtcaaatcggagaaaaaaagcttttgaggagaaacgaaaagaacaggaagaaaaagaacaccaaattagagaacaaatacttcaacaaagaaaacagaagtttgaagaagttactgaaaaattccagcgtgcccatgttcctctttcacagcggaggaaagcagtttcccgaaaaccagttcctccattagaagaggccctcaaacaaattcaggaatccaacttaaaatcagaagtaaaccttcccttttcccgtagaccaacaataaactggagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaattttgtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagacnattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcaatgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttctctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattgaacctctttattaaacctctaacttactgataagatgtttatgaagtatggcatattttgatttttttaattgtaataaatattcttaaagttaccacatcccacaaaatggcccttggtggcagcaatagagcaaaggttacctttttgtatggtgaagggaggccttcctatggctgtacaattacatcgattcttccaaatttcatatttcatacatggcactttggcataccgaaaaaacatgaaatttttcattaaaatgccatgaatcaagccagggccgttggcttatgcctgtaatcccagcactttgcaggccgaggtagacagatggcttgagctcaggagttcgtgaccagcctgggcaaccctgtctctacaaaaaatacaaaaattaaccaggcatggtggcatgcacctgtagtcccagctacttggggtgctgaggcgggaggattacttgagcccaggaggattacttcaacctgggaggttgaggctgcagtgagctgtgtttcgccactgcacaccagcctgggtgacagtgtgagacccagcctcaaaa

SEQ ID NO: 444224 - DNA, 3668 bp, Homo sapiens
  misc_feature (2163)..(2163): n is a, c, g, or t
tgtcaaggacgcgccgtcggttgttgtcaagatggcggctgcagggttgctgccgccccatctgctattgcccggcgaggtcgccgctgcctcagctgccatcgccgctacaggcaccagtgccgctgcgcgggagctagggctgtcgaggccaacccttccgcgcccgtgacgcggggcctgagagacggagtgtagggaggggccgagcaggaggaggaggaagccggagctgccatgagggaggttctgggggcgagcagacaggcggcgctgaagtgaaggatgctggcggggaggcccggaacccggagcgcggtcggggaactgggcactgaatcatcggacaacctcgacagagcccccctcggccctcgggagagcggcgggcatcaccgacctggctcttacctagatatgaaaatccatctggagaaaaatttagaagaagagcgccagatattactgcagcaacaaaaaatatgtcgaaatcgagcacgtaaatattttgtggagtcaaatcggagaaaaaaagcttttgaggagaaacgaaaagaacaggaagaaaaagaacaccaaattagagaacaaatacttcaacaaagaaaacagaagtttgaagaagttactgaaaaattccagcgtgcccatgttcctctttcacagcggaggaaagcagtttcccgaaaaccagttcctccattagaagaggccctcaaacaaattcaggaatccaacttaaaatcagaagtaaaccttcccttttcccgtagaccaacaataaactggagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaattttgtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagacnattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcaatgaaagactacattatatacaagaatccatttgcaaaaacccatccatcaaaaatactttacaaataataccacttctggtaagtatttgaagaagctctttttttcttgttttaggaaacttctgattttatgtacacatcaatacaggtaa

SEQ ID NO: 444225 - DNA, 566 bp, Homo sapiens
  misc_feature (6)..(6): n is a, c, g, or t
ggctangtacgaggccggtggtgaatcggccgaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444226 - DNA, 633 bp, Homo sapiens
  misc_feature (609)..(609): n is a, c, g, or t
  misc_feature (628)..(628): n is a, c, g, or t
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccagagggggaaacggtagtaaaacgggccttggttgangcaaaaaagcttttggaanttggg

SEQ ID NO: 444227 - DNA, 568 bp, Homo sapiens
ctcccttctcacgggaattttcaggataaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacgagcatacagcacacacacaaacgcacagcacacacagcacacagatgagcacacagcacacacacaaacgcacagcacacacacgcacacacatgcacacacagcacacaaacgcaaggccttttacacacacacaacacatacacacacacacacacacacacatatcacagttttcacacagcccctgctgcattctctgtccatctgtctgtttctattaataaagatttgttgatctgttcca

SEQ ID NO: 444228 - DNA, 437 bp, Homo sapiens
  misc_feature (26)..(26): n is a, c, g, or t
  misc_feature (61)..(61): n is a, c, g, or t
  misc_feature (106)..(106): n is a, c, g, or t
  misc_feature (183)..(183): n is a, c, g, or t
  misc_feature (192)..(192): n is a, c, g, or t
  misc_feature (205)..(205): n is a, c, g, or t
  misc_feature (222)..(222): n is a, c, g, or t
tttctgggaagctccgagtctaggtnagccgcccgtattggaaaggccaggaattcaactnccatgtgaaaatctcgttcttaagttttgtctgtaatggtaaagnacctgtacaatgcttgggacatggcatgtccttcgacaaacgttggttcccttttccataacttatttgatgcttcnaaactcaantttccacccatanagtcctccccgcccganacacacacacacacacacacacacacacacacacacaaacttatttgatacttccaaactcaactttccacccatacagtcctcccgccttttacacacacacaacacatacacacacacacacacacacacatatcacagttttcacacagcccctgctgcattctctgtccatctgtctgtttctattaataaagatttgttgatctgttcca

SEQ ID NO: 444229 - DNA, 1711 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444230 - DNA, 2042 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccaaaaaaaaaaaacaaaaactggaaaatagtctctctctccccttggtccaagggtcacatatagagcgcaactcctattagttctctaagggccgtgcacgcgcaggtgggtctacaagaaggctctccccctaataaggaggagcttatcaccttttattgataacgcctaaataataatttccttatctggtccaaagtacggtatgcacttttctaacacttcaaacaatttccttatataaatctcagcgcctgagaataacccgtgtgaatgcggcgcaaattgatgcttaagcccccaccaggtcttataaaaaggggaaccccta

SEQ ID NO: 444231 - DNA, 1661 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatcttttacacacacacaacacatacacacacacacacacacacacatatcacagttttcacacagcccctgctgcattctctgtccatctgtctgtttctattaataaagatttgttgatctgttcca

SEQ ID NO: 444232 - DNA, 1556 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444233 - DNA, 1508 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444234 - DNA, 1664 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgaggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444235 - DNA, 1180 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagcacacacacacacatatcacagttttcacacagcccctgctgcattctctgtccatctgtctgtttctattaataaagatttgttgatctgttcca

SEQ ID NO: 444236 - DNA, 1734 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggtgtcatgtgcgattgtcactcagggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444237 - DNA, 1967 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggtcagtgctagcggcgggccagactgggaggctggggttgtaaaggggcccatgccctcctttctgatgtttggctgggccatgcaatggcgcgaataccctgatagtgtcatgtgcgattgtcactcagggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444238 - DNA, 1128 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcaccacacacacacacatatcacagttttcacacagcccctgctgcattctctgtccatctgtctgtttctattaataaagatttgttgatctgttcca

SEQ ID NO: 444239 - DNA, 1744 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444240 - DNA, 1597 bp, Homo sapiens
aatagtgaaacaatttacttaagaaatagagcactggacttcccagtatatttgaggttgggtgtatgcatcgcaggcatggtggttgaacagctacacttttcagataaagcctcacaagtcctggaactacccctttcctagctacaagcccagcccaggtttagctaaatttctgcttgattcgagtgaggcttgggagtgcagacttccatacagtgggtccatggccaagcgaggtagccgtccatggcttctccaaagagaggacgtgggtcagatgatgccacagaacatttaggagtggccatctgggccagcccagtgaggtagggctttttgtttttctgaagctccctctccattccccacccctagttagtccatgggccagggaagcagcagccatggaagggcagggcagagctggcttttcacttgggtgctccctgtcccccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444241 - DNA, 1493 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444242 - DNA, 1442 bp, Homo sapiens
aatagtgaaacaatttacttaagaaatagagcactggacttcccagtatatttgaggttgggtgtatgcatcgcaggcatggtggttgaacagctacacttttcagataaagcctcacaagtcctggaactacccctttcctagctacaagcccagcccaggtttagctaaatttctgcttgattcgagtgaggcttgggagtgcagacttccatacagtgggtccatggccaagcgaggtagccgtccatggcttctccaaagagaggacgtgggtcagatgatgccacagaacatttaggagtggccatctgggccagcccagtgaggtagggctttttgtttttctgaagctccctctccattccccacccctagttagtccatgggccagggaagcagcagccatggaagggcagggcagagctggcttttcacttgggtgctccctgtcccccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444243 - DNA, 811 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcggaaaaaaaaaggtgggaggatgtgaattgttagtttttgagttttaccaaataaagtagaatataagaaga

SEQ ID NO: 444244 - DNA, 1478 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgaggcgctactgggctgagatctcggataccatcatctctggcaccttccaccagtggagagagggcaccaccaaaagtgaggtcttctacccagggtgggtaagaaggctctgtcagagaagtgggtcccttcacgcggggggtgcccacaattgcggggagcatggcatggaaaaggagtgtgttgggggggccctcctcatggttcccttcctccaccctcccataagccacaggtgattggttggggcagagctgagggactcttgctttcctctgtcaaggggaaacaaaacataacaacttcctattaaacatgtctgatttttatctgcccaggcacaattttgcccagacagtattccaacaactgttggggagacaatgggtaatcagaaatgctctccatctcaaaaaaaaaaaagaagaagaagaagtggtcagattcaggacgtgttttgaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctgg

SEQ ID NO: 444245 - DNA, 1700 bp, Homo sapiens
tatttcggctgggtataaaaaaaaaaaaaaaaaaaaaaaaaaaaaaaaaaaaaagtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444246 - DNA, 2027 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccaaaaaaaaaaaaaaaaaaaaaaaaaaaaacactttttgggccccctgggccctttaggaacgtgttttaagacccttgcggtggggcccggggcccccagttgtgtgttagcgtgaaccctggtgcccatgctctggctccctcaaagagaaccccgggatcacagagaatcatggcttagggtattcccccccgattaaaaaaccccgcgcgggggacaaccggcttcttccgagcaacattcccgagaggcgttccaaggggcaccacggggcgttctcacccacgggattccaaggaaccccatattcaattac

SEQ ID NO: 444247 - DNA, 1387 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactaagcaagcaaagcccgtcggctagtcaagcggatctcagagc

SEQ ID NO: 444248 - DNA, 1826 bp, Homo sapiens
tatttcggctgggtataaaaaaaaaaaaaaaaaaaaaaaaaaaaaaaaaaaaaagtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444249 - DNA, 1294 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaagggaagggattttataacttgccttcaagtcctgaacttcctttaaaacccaagcagagtaaatttgtgagagggaattgaatactctcaaacaattacatctttctcgtgtcctg

SEQ ID NO: 444250 - DNA, 1841 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggtcagtgctagcggcgggccagactgggaggctggggttgtaaaggggcccatgccctcctttctgatgtttggctgggccatgcaatggcgcgaataccctgatagtgtcatgtgcgattgtcactcagggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444251 - DNA, 1657 bp, Homo sapiens
  misc_feature (6)..(6): n is a, c, g, or t
ggctangtacgaggccggtggtgaatcggccgagggtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgatgtcatgtgcgattgtcactcagggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444252 - DNA, 1618 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444253 - DNA, 1024 bp, Homo sapiens
  misc_feature (6)..(6): n is a, c, g, or t
ggctangtacgaggccggtggtgaatcggccgaggcctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 444254 - DNA, 1781 bp, Homo sapiens
agggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggtcagtgctagcggcgggccagactgggaggctggggttgtaaaggggcccatgccctcctttctgatgtttggctgggccatgcaatggcgcgaataccctgatagtgtcatgtgcgattgtcactcagggcgctactgggctgagatctcggataccatcatctctggcaccttccaccagtggagagagggcaccaccaaaagtgaggtcttctacccagggtgggtaagaaggctctgtcagagaagtgggtcccttcacgcggggggtgcccacaattgcggggagcatggcatggaaaaggagtgtgttgggggggccctcctcatggttcccttcctccaccctcccataagccacaggtgattggttggggcagagctgagggactcttgctttcctctgtcaaggggaaacaaaacataacaacttcctattaaacatgtctgatttttatctgcccaggcacaattttgcccagacagtattccaacaactgttggggagacaatgggtaatcagaaatgctctccatctcaaaaaaaaaaaagaagaagaagaagtggtcagattcaggacgtgttttgaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctgg

SEQ ID NO: 444255 - DNA, 779 bp, Homo sapiens
  misc_feature (774)..(774): n is a, c, g, or t
tcttgagacttcacttcagcttcactgacttcttgactctcctcttgagtaaaaggactcagccaactatgaagttttttgtctttgctttagtcttggctctcatgatttccatgattagcgctgattcacatgaaaagagacatcatgggtatagaagaaaattccatgaaaagcatcattcacatcgagaatttccattttatggggactatggatcaaattatctatatgacaattgatatccttagtaatcatggggcatgattatagaggtttgactggcaaattcactttttactcatttattctcattcatcataccgcatcacactaccactgctttttgaagaattatcataaggcaatggagaataaaagaaagaccatgatttagtgaattctgtgtttcatgatacttcccttcctaattatcatttgattagatacttgcaatttaaactgttaagctgttttcactgctgtttctgagtaatagaaattcattcctctccaaaagcaataaatttctagcacaaaaaaaaaaaaaacaaaatggggggggggggccgaaaaattttgaaccacttgtggggcgggcgcgaagggtagtgacagcgcccacggtcccagaggaaccgggcgcaaggggggttccccaaaagccgggggcggtggcaaccgcgtggggtcggtccacgacgacaccccccgcggcgcaccgaaaaataccaacagcaccgacaatcgcacacgcaactacaacacaaaagnggaga

SEQ ID NO: 444256 - DNA, 1427 bp, Homo sapiens
ttaaaaagaacttcagaagccatgcatggtgatgcatgcctgtagttccagctactcagaggctaaggtgggaggattactttcgcccaggactcagcctgggcaacatagggagacctcgtctttacaaaaaattttaaagttagctgggcatggtggcacacaactgtagtcccagctacatgggaggctgaagtaggaagatcacttgagcctgggaggttgaggctacagtgagctgtgaccaaccagatgaatagtactcagggatccttagagatggacgggaagagtggataggggtaggaaggcagaagaggtgcctaattcgaacataaagaacatcatcccctgacacaggaaatggaagaagggattccccaaacggtggatatcaaatctaggatctttgaattataaaaatatgtgctaagtttggtcagattatgtgccagggtctatgagcatatgaattctttccacaaaggagcaagaaatttctaagccataagcgaagacaaaatttgctattttatagccacaccatctgtgtgtgctcagtctccataatttgctacttgtccaatgtggccatctacttacaaatttcggcgcgaatatcggcctggggccacttctgcccagcccagatccttgccggtgatcctagggtcaattctccaccgcacgctctttgagtaacttattcagaagcccttttaccgctctgcttcacacaggcgggctactcctcgttcattatactttacttctaggtcatcttcgacactcccgcagcttcctcccactccctcaatggcccactttggctggtctctccctctcagcaaccttctcctcttcgatccgctctaatgccttctctaactctcttcctcctcaactccgtgtgattctcattccactctcgtctctctcctctctccctctctccttgtctcctcacgtctgctcacctctcctactccgctattctacgttccgacatctactctagtgcatacgtctccgtccacctcactctcctcacgattctcgtccgccctctccttcgtgtttatacctccttctgctcttatcgctcacgtatacacatctctctctctctctccctcgtctcggctaccgatctctctctctctcatctggtctcgcctagcattctctctgctctactctctctctcgttcatctatctcgattctctctctctctcgtcgccgctgctctatctatctcatcctctacactctctcatcctcttctcacacgctctacagatcttctccgctctcatcgatgtcttcatgtgcctcctctctcttcctctccgactcgatacatatacacatgcgcctcatctctctctacttcgcgcactgcgcctgctctacgtcactctcgcc

SEQ ID NO: 444257 - DNA, 8417 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtcaaaagtgcttttgtttctttgtttaatgtaatttttgtgcttcacctacaggatgctgcagtaaattaaatatcagtgaagcttctgatgtataaagaatgctatgaataaaacattaagaagctgtgtaattttaagttatagttgcctctatttttaccatttcattggtaaaaattagctaatttttttcaagtgaaatgaaaaataaaaatataaatttatcaat

SEQ ID NO: 444258 - DNA, 8040 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacaaaaaaaaaaaaaaaaaaaaaaaaaaaaaaaaaaaaaaaaaaaaaaaaaaaaaaaaaaaaaaaaaaaaaaaaaaaaaaaaagcagataaaagaaaagacacaacaaaaacaaggcagacaaaaaccaacaaagacggaagagaagagggcgcaggcccaaccacaagaaagtagaagagacaaccaaacgaggagagaggagagagaaaaaaagagagggaaagtgaggaagtgtacgagacgaacaaaagagtgagaggagagggagggcgacagcgagaaggggggaccaggagaaaggcgggaggggagaagaagaggcggggcagaacgcagagaagaagggagggcagcaaggagacgggggaggacagaggacagagagaaaagagaa

SEQ ID NO: 444259 - DNA, 7809 bp, Homo sapiens
cgtccaggctgcgccgccgcgccgccgctccgcccccggtcgggtgtgtggctgcgcgcgccgggagagatgctgagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtca

SEQ ID NO: 444260 - DNA, 3996 bp, Homo sapiens
aaagctagttgagagagcatactctggtttttcatctctcacagtagtcaaagaagttacatatacaattagaatttgttgtttctgttgccagaaactcaatacaatttgtcacatcaggaaaggttttttgttgttattgttgttgtttttgagacggaatttcacttcactcttgttgcccaggctggagtgcaatggcgcgatctcggctcaccacaacccccacctcccaggttcaagcgattctcctgcctcagcctcccaagtagctggaattacaggctttgtcactacgcctggctaattttgtatttttagtagagatggggtttctccatgttggtcctgctggtgtcgaactcccaacctcaggtgatccgcctgcctcagcctcccaaagtgctgcgattacaggcgtgagccactgcacctggcccaggaaaagttttttacatacgaattaaagatgcttctttatgcaaatttttaaaccccaggtttgaagtaggataaaaggtaacattaaatctgagatcatttctagctctggaattctgtgattgtaatgagttttgatttctaaatgttttttcctttcataatttcagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtca

SEQ ID NO: 444261 - DNA, 3913 bp, Homo sapiens
cagcgttattagaaatgcaagagagctggaggctcggggtgtagctgaggttgaaaggtgcacggaaaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtca

SEQ ID NO: 444262 - DNA, 2368 bp, Homo sapiens
tctatcttctgtcctgaggtcagaataatttgttaaaaatataaatgggggccgggtgcggtggctcacgtctgtaatcccagcactttgggaggcccaggtgggaggattgtttcagaccagcctaggcaacatgactctacaaaaaaattaaaaaaattagccggatgtgatggtacatgcctgtgatcccagctccttgggaggttgaggcgagtggatgaccttgagaccaggagtgtcagaggctggttgagctgagaggagcctctggggtaatgaagatcccctccttgcaggaggagaagagctggagctgatgggagaagatgcgtcttgctcccatcagatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtca

SEQ ID NO: 444263 - DNA, 4715 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacaggtaggatagaagaatcattgcaagagatttgattttaaatttcacttttgatacaccaacagtttgtcaaatgtttgtgatttgttaatatagttctcattattaggattatttagtattaactccatctgatcaggtaaccatctgatatttgaaagaagtttttgttgttgaccagtaatgcttttattggacttctcttgaagtaataaatggctaagttgaat

SEQ ID NO: 444264 - DNA, 1021 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacaggtatttttatttttttagggttttttggcaaataaaatgcactacacatttcaaacatgtaaattttataaattggataattatcagatagaaaaggggactcagactaaacatatagttgaattttgtttttctaatttatatctaaaaagatatatgattagttttgtaatgtaattattatataaatagtaagtgtggtaagtatattttcctttttaccacattctctgtaaaatcttagaatt

SEQ ID NO: 444265 - DNA, 252 bp, Homo sapiens
cttcctctctttccactaaagaaaagtatcggggtgggggtggggagccgcgcgggagcgcgcgcgcacttatccacacagaaatactccctctcaccctccctcttcagcgttattagaaatgcaagagagctggaggctcggggtgtagctgaggttgaaaggtgcacggaagtaagggcaaactgttattaggccgtttagtaaaatcccgaaaaagttgtaggggagacgcttatacttctaccatgt

SEQ ID NO: 444266 - DNA, 500 bp, Homo sapiens
ccacaaagtgaaagaagataaaaaggtaaggttaacttaaggtcagtgatgtttataaaaatgcttgttgttgcttttttaaaatactgacatcagtgttagaatttagtctcattcattccatacataataattagtagccctttttaattttctgagtattctgtggggataagtgattttttgttatttttgtgctttattggggtagagtttgatttcatattcttcagcataaaaattcttggtgaatgtgttttttctttttacagaaacccagatatgaagtgattttgttcttaatttttccatttgtaatcatcctatttttctgtttttcccttctgccctaccagttttgcggtattaatttgacatacctgtctcactcaaggatattaataatacaataaaattgtaacagtttacagtcttggatatttattaacttttccaggaagcttctttgcagatggtggtatactacctgaaggtataca

SEQ ID NO: 444267 - DNA, 8189 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtca

SEQ ID NO: 444268 - DNA, 7988 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtca

SEQ ID NO: 444269 - DNA, 8044 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtca

SEQ ID NO: 444270 - DNA, 5052 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacaggtatttttatttttttagggttttttggcaaataaaatgcactacacatttcaaacatgtaaattttataaattggataattatcagatagaaaaggggactcagactaaacatatagttgaattttgtttttctaatttatatctaaaaagatatatgattagttttgtaatgtaattattatataaatagtaagtgtggtaagtatattttcctttttaccacattctctgtaaaatcttagaatt

SEQ ID NO: 444271 - DNA, 4723 bp, Homo sapiens
cgtccaggctgcgccgccgcgccgccgctccgcccccggtcgggtgtgtggctgcgcgcgccgggagagatgctgaggtaaagttcgggagagagggagagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgcgccaccgccgggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaagacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaaggtaaggttaacttaaggtcagtgatgtttataaaaatgcttgttgttgcttttttaaaatactgacatcagtgttagaatttagtctcattcattccatacataataattagtagccctttttaattttctgagtattctgtggggataagtgattttttgttatttttgtgctttattggggtagagtttgatttcatattcttcagcataaaaattcttggtgaatgcgtccacggacgcattcacccgtgtctgttcactgaccaaagtccacaatttgtcaaggttgacagttgggcagaagctctggttcctctttaagtggtaatgcttcataccaactttcccaaagtagcctgaatggtcgtcgaattgcac

SEQ ID NO: 444272 - DNA, 443 bp, Homo sapiens
ctcccctacctgcacccccaactcccacccctgtccgtctagctcatgcagactgagatatttttttttcccctctaagcattagccgccctgaattaacgttttcacgggcagccccctcaatgtgtgctttctggtagtgactttgttctaaagctcactttgctcccccagcggctacaaaggaccaattcccaaatccccatcagcctccctcccagctgtcactccctcagaagactctggagcaaagggccaggtttgagactggagaccagaggttaggggtggactgcggttctcaagatcagggtctgaaactcccctgggtcttctctcatctgtgcagatggtccactctgcttcattagctcttcagcacttcactctgttcttcttcatcctaggggtactttccttgtttttttctccggcaagttctt

SEQ ID NO: 444273 - DNA, 1023 bp, Homo sapiens
  misc_feature (6)..(6): n is a, c, g, or t
  misc_feature (8)..(10): n is a, c, g, or t
  misc_feature (13)..(15): n is a, c, g, or t
  misc_feature (26)..(28): n is a, c, g, or t
  misc_feature (31)..(31): n is a, c, g, or t
  misc_feature (55)..(56): n is a, c, g, or t
  misc_feature (59)..(59): n is a, c, g, or t
aggcanannnatnnnaaaaatcaaannnaanaaaaaagacataaagacatacatnnacnaaaaaaaattagaaaaacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaatgattagaggaagaccatagggaaagacagaacgagataccaacaagacgccggaaatgctgaaaggcgaatattaaagaatacagtgaagtgaca

SEQ ID NO: 444274 - DNA, 2199 bp, Homo sapiens
acagtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444275 - DNA, 2089 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444276 - DNA, 2319 bp, Homo sapiens
acagtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggtaagaactctgtcgtttttattctgccttttctactgccttggctgtccttttctttgccatcgtctcaagttttctgcaaacttgttttggtctttccatctttttctactctgccaggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444277 - DNA, 2579 bp, Homo sapiens
acagtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggtaagaactctgtcgtttttattctgccttttctactgccttggctgtccttttctttgccatcgtctcaagttttctgcaaacttgttttggtctttccatctttttctactctgccaggcaaatgatttggtgaagtaccttttggctaaagaccagacgaagattcccatcaagcgctcgggtaaagtcctaccaatcctccctctgccctgagctctgccctccattgcccttacaccattgtgctggggatatcccctgctcttatgcttatgtctctgtcctcccaaagttctgatttggcagtgctagcatctctgttgataagcacagaaccgggttatgccacccttggtgtggttggcaaagagtctatagcttgggcatcagggccacctggcatctcttcagtcaggtgctcacaacactctccccttgcagacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444278 - DNA, 2417 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggtatgattgggctctctcagcgcttgctgtccgtgttgtcctttggcaagagaggacggtcctaggattgcatcagtctggtggtctggtggagcgggtggggtgctggactgggtagagggcccagggttctgacctgggtggatgatgggtgaatggtcctgaactctctggctccctctctcagtgtctcttgggcttctatggagcttccctcttgtgctggaaacctcttttccatcttggaaatgcctctgcccacatctgggaagtgccatagccttgagtgaatttatttgtttatttatttttctttttcttctctcaggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444279 - DNA, 1840 bp, Homo sapiens
  misc_feature (4)..(4): n is a, c, g, or t
  misc_feature (25)..(25): n is a, c, g, or t
aacnaaataggtcaggtacgaggcngggtgttgaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444280 - DNA, 2100 bp, Homo sapiens
  misc_feature (2068)..(2068): n is a, c, g, or t
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaattccatatacaggaccacgttgggncagcctctgccatatatatttttgtccgtttt

SEQ ID NO: 444281 - DNA, 1981 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444282 - DNA, 1921 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444283 - DNA, 2283 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcacttcgtgggcagcgctgcccacgaagtgacttgtactgcctccagaaagggagccaagttacaccaaagcttgaggtccgcctgtgcccaacacacttcctggcacacagaagacccatcaaaactctttctttcccctccttcaactcccagtatttattaaaaagctagttgtcatctgcgtggctctgccgcctggtgatgggggatggagacctctccatacagagctccacctcccatccccacttcgtgggcag

SEQ ID NO: 444284 - DNA, 2015 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgcgtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444285 - DNA, 1988 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccaaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444286 - DNA, 1238 bp, Homo sapiens
gtttctacctcaaaccccttatttatgaagtagagagatctgccctgtgtatccagttatgagccatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444287 - DNA, 1572 bp, Homo sapiens
  misc_feature (1525)..(1525): n is a, c, g, or t
  misc_feature (1533)..(1533): n is a, c, g, or t
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaagaagatnccaggaangggcagatcagtcccagtcggcgagagggtcctctggtc

SEQ ID NO: 444288 - DNA, 1730 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctggatacatcattcactctttgggcgacagtgacagaaagctcatcactgactgaactcgctgaaagcccgaaagtaccgtgcaccacgcccagaagtacccaacagcaaaccccccgacaaacgcagaacactgggggccaggcccccaaccatggacaccgccagaatacacgccccaagatgcccgcaacgctccaccacggcccccaggacgggcacccacacccaagcgccgcaccgcccacaccgaacacaccaagacccccccgccgcaaccccaggcctcgccccccacacacgccaccagccacccaccacccacaccccccaaccccacccacccaccccccccgcccaaccccccccaccacccccccacccccccacccccccacacc

SEQ ID NO: 444289 - DNA, 1333 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgggaggagaggaagggtaccgagctcg

SEQ ID NO: 444290 - DNA, 1071 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaatgattagaggaagaccatagggaaagacagaacgagataccaacaagacgccggaaatgctgaaaggcgaatattaaagaatacagtgaagtgaca

SEQ ID NO: 444291 - DNA, 1496 bp, Homo sapiens
  misc_feature (4)..(4): n is a, c, g, or t
  misc_feature (25)..(25): n is a, c, g, or t
  misc_feature (857)..(857): n is a, c, g, or t
aacnaaataggtcaggtacgaggcngggtgttgaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattcnttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggactcagaaacctactcaacacagcactctaggcagccactatcaatcaattgaagttgacactctgcattaaatctatttgccatttctgaaaaaaaaacaaaaaaaaaaaaaaaaaaaaaaaacatgtgtgtgcgggcgcgccctgggcctctggaaaaagctcttccaaaaaccacattcgcgtgtgggcgcgccgccggggcccccagttgggttaggtgtgaaccggggccccatagcgtggtccccaagggaagatcccggggtccaggagacaaaggcggctggggatcctcacacccatttaaaacaagccgccgggggcgacacaggacgcgttccggagaacaacttccagagagggggacgtccagagacgccatcacgcgggttcctacacagacgggagccccacggggacgcccggatatcaaataaggc

SEQ ID NO: 444292 - DNA, 441 bp, Homo sapiens
agaaagtttcccccacggggcattaatcccgtccagaacccggagccgcccgatcgtagagaaggcagacgcatcccgaactcgctggaggacaaggtgaggggcgttgatattggggttttatggaggtcagacagtggttccagacccctcgaacccatagccaggcagatgagcaattcttactgcaccactgcagctgaagcagaggtgacctggagtggggtgtaggcaatgaggacgactgagaaagtagtaggctgtacagactgggagcagagactagcggagggaggaggggagaaaaacggggaaccaggaatgttgggagggggacgaggaatacaaggagggaggggaacactgagggggagtgaagatccagagaagagaatcggggatgcagagagggattaaggaatactgaggggcagggtgtgc

SEQ ID NO: 444293 - DNA, 387 bp, Homo sapiens
cctgatatgtcattgccctgttacagatgagaaaaccgaggcccagaaaggttggtaggtgacatgtccaaagtcatggggctaggaagtgtcagagcagggatggaatattaggtgcataattactggtaatactgtattattactattatctttttatactaagcatgtagcatagtgcctagcataaaggtagatgcttaatcctcttatgctccttctgatggttatttacatagtaatactgtattattactatggcttaatccctctatgctccttctgatggttatttttgtttcaggtacaaaagaaggatcccaaggaatgggcagctcagtaccgagaggcgatggaagcggatttgaaggctgcagctgaggctgc

SEQ ID NO: 444294 - DNA, 355 bp, Homo sapiens
ctggtgcctgtggtttctcctacaagtgagattttaggtatctgccttggtttcagtggggacatctggggcttatggggctgggatgaggagctggatgattctaggaaggcccaagttggagaatgatgtggagagtgtgccaagacactgcttttggcattttattcctttctgtttgctggatgtcaattgacccttttattttctcttacttgtgttttcagatattgttaatcctgccagtctttctcttcaagccagggtgcatcctcagaaacctactcaacacagcactctaggcagccactatcaatcaattgaagttgacactctgcattaaatctatttgcca

SEQ ID NO: 444295 - DNA, 2084 bp, Homo sapiens
accacttccggcctagagaggggagggcagtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444296 - DNA, 951 bp, Homo sapiens
acagtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgggaggagaggaagggtaccgagctcg

SEQ ID NO: 444297 - DNA, 2290 bp, Homo sapiens
  misc_feature (127)..(127): n is a, c, g, or t
gtcacggaggttgacaactcagtgagttagctttattgggaggggtgatctagacaccctgtacgccgcgttctatttgacctgggttaatcgtgtgaccgcgtggcttggcacgaaagtgaccaancctgggcttagtatagcttagttaaactttcgtttattgctaaaggttaatcactgctgtttcccgtgggggtgtggctaggctaagcgttttgagctgcatgactgcgtgcttgatgcttgtcccttttgatcgtggtgatttagagggtgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444298 - DNA, 2441 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctgaaaaaaaaacaaaaaaaaaaaaaaaaaaaaaaaacatgtgtgtgcgggcgcgccctgggcctctggaaaaagctcttccaaaaaccacattcgcgtgtgggcgcgccgccggggcccccagttgggttaggtgtgaaccggggccccatagcgtggtccccaagggaagatcccggggtccaggagacaaaggcggctggggatcctcacacccatttaaaacaagccgccgggggcgacacaggacgcgttccggagaacaacttccagagagggggacgtccagagacgccatcacgcgggttcctacacagacgggagccccacggggacgcccggatatcaaataaggc

SEQ ID NO: 444299 - DNA, 2134 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggtatgattgggctctctcagcgcttgctgtccgtgttgtcctttggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444300 - DNA, 2279 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtatctgccttggtttcagtggggacatctggggcttatggggctgggatgaggagctggatgattctaggaaggcccaagttggagaatgatgtggagagtgtgccaagacactgcttttggcattttattcctttctgtttgctggatgtcaattgacccttttattttctcttacttgtgttttcagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444301 - DNA, 2032 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcaaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444302 - DNA, 2677 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcgggtaaagtcctaccaatcctccctctgccctgagctctgccctccattgcccttacaccattgtgctggggatatcccctgctcttatgcttatgtctctgtcctcccaaagttctgatttggcagtgctagcatctctgttgataagcacagaaccgggttatgccacccttggtgtggttggcaaagagtctatagcttgggcatcagggccacctggcatctcttcagtcaggtgctcacaacactctccccttgcagacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggtatgattgggctctctcagcgcttgctgtccgtgttgtcctttggcaagagaggacggtcctaggattgcatcagtctggtggtctggtggagcgggtggggtgctggactgggtagagggcccagggttctgacctgggtggatgatgggtgaatggtcctgaactctctggctccctctctcagtgtctcttgggcttctatggagcttccctcttgtgctggaaacctcttttccatcttggaaatgcctctgcccacatctgggaagtgccatagccttgagtgaatttatttgtttatttatttttctttttcttctctcaggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444303 - DNA, 1693 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444304 - DNA, 1950 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444305 - DNA, 1408 bp, Homo sapiens
gtagcctacaccactttgtcaaaggactcttccatcagagatgggaaaaccattggggaggactaggacccatatgggaattattacctctcaggcccgagaggacagaatggatataatctgaatcctgttaaattttctctaaactgtttcttagctgcactgtttatggaaataccaggaccagtttatgtttgtgcttttgggtactacgctttggcatgcccaagcgtagatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctga

SEQ ID NO: 444306 - DNA, 1894 bp, Homo sapiens
  misc_feature (1607)..(1607): n is a, c, g, or t
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaagtaccttttggctaaagaccagacgaagattcccatcaagcgctcggacatgctgaaggacatcatcaaagaatacactgatgtgtaccccgaaatcattgaacgagcaggctattcnttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggactcagaaacctactcaacacagcactctaggcagccactatcaatcaattgaagttgacactctgcattaaatctatttgccatttctga

SEQ ID NO: 444307 - DNA, 1676 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggcatatagcgctttcgacgacaaggtacttggagacttcaattgacaggacaacgtggaataaaagacaatgaacacatttggtacaaattaatataataaaagagaacatatactaagcacgacgcagaattgcaagaggaactagctggggacaacagaagaaaacagcgacacccgacgaccaaaagcacagagagcacatgcacccaagtgcgagaaagacaaaaagaggaatcacaagatgcgagtggcacaagagaaaaaaccggacaaccagcaagagggacacgacacacgagaagaaaaagaagacgcgaagcacaaaagacataggacgggccaacgagacacacataagcaggaacacaccccctgaacctagccaacaacacgacaagcacagcaagcggcagaaaaggcaacgaccacccagtacacgagagaaggaccgaaaaagaggaagaaaaagcacaaacacagccacaccatgggaaacaaacaaacccagagaaccaccccccagcaaacaccaacaaacacgaacaatgggacaacaaag

SEQ ID NO: 444308 - DNA, 1050 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcggggtgggcttgagggggcacgctgggcgcctggtaaacaacaaatcacaaggcggaggaagagcaaaaagggggcaaaagagagacacaagggacggagaacac

SEQ ID NO: 444309 - DNA, 781 bp, Homo sapiens
agaaagtttcccccacggggcattaatcccgtccagaacccggagccgcccgatcgtagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaagggggaagctctggatggggagaggatggagcgtgatcagagcaagctctggaacacaggggccacggtgccaaggcgaagggcaaggcgccgggaggggcgccacctgccggcgagcgg

SEQ ID NO: 444310 - DNA, 4390 bp, Homo sapiens
ggcgacagggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgaaaaaaaaacacacacacgaagcgacaaaagaacaaaaaaaggaggggggggccaaaaaacccccggggggcatacgagagcaccctttttggaaagggcgcccaggggcgtaaaaaaagggggccggaaacgggggggaaaccgggccggggcccccgggggggggacaccgaaacgg

SEQ ID NO: 444311 - DNA, 4609 bp, Homo sapiens
ggcgacagggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgacgtatctgtcttagttccttttactccagtattcctgaagttttgctgagaacattgtgagttgttggtgttttgcccagaacatccacgtcttacagagcatgaccttggtgctaaccagatctgaagtaaggaggagcccactggtggccgtggggtgtctccttcctgcatggagctggaggatgaaggcaggctagcacagcatttagaggcactacctcttgatactgggcagatctggattttagccctactaccgacctttgtatgcctttgggcaaatgacctgccttagtcttgagctgccttgcctgtgaatgggacactaatgtgcacttcaaagtagctggaggactaaagctaatgtaggagtgtggtgaggagcccagaaaca

SEQ ID NO: 444312 - DNA, 4589 bp, Homo sapiens
tcaggcgattcacccgcctcggcctcccaaagtgttaggattacaggcgtgagccaccgcgcccggcttgaattgtacacttcaaaaggtggaattttatggtgttgaattatatctttatttttttaacggggggaaaatgacgccgctggagaggagttagcggaactgaaacaatgaaatggtgcgcgagtgtcgcctgtccccgtcgcatccatcccaacgaagtttgggccctggaacggtgcacccagaaggcctgcggggagagacgctggggcatgatctggaagaaagacgtctcaggattcgaagggaatgcagctaaggtggcggcggaggttcgcctaggactggggaggcgtccctaggctcagaagttggcccggccggagcggagatttaaaggttggagcgcagaggctcttaaagaggccgagtcgaattcccactcggcgtccaccttaaagccagctccccggcaccacggatctgacccgggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgaaaaaaaaacacacacacgaagcgacaaaagaacaaaaaaaggaggggggggccaaaaaacccccggggggcatacgagagcaccctttttggaaagggcgcccaggggcgtaaaaaaagggggccggaaacgggggggaaaccgggccggggcccccgggggggggacaccgaaacgg

SEQ ID NO: 444313 - DNA, 4179 bp, Homo sapiens
ggcgacagggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgaaaaaaaaacacacacacgaagcgacaaaagaacaaaaaaaggaggggggggccaaaaaacccccggggggcatacgagagcaccctttttggaaagggcgcccaggggcgtaaaaaaagggggccggaaacgggggggaaaccgggccggggcccccgggggggggacaccgaaacgg

SEQ ID NO: 444314 - DNA, 3948 bp, Homo sapiens
ggatagaatcagaatgtatttttgataaatgaaacagtctttcatcttcaagtatataaaaagatcactttattctatttttagggagctattaaatatctctgtgcctagagaacaagagggaattggaaaagccattagtaacactttccaacctgaaagagtgaaaagccctaaatgatgcttgaggctattgggggctggggcttctgtggggggttttgaaagcacctgggttcctcagaacctctgggcatttttaagggtgtaacagggctttgaggatctctgtgccactttgatcaagttgagctttgccttccagattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgaaaaaaaaacacacacacgaagcgacaaaagaacaaaaaaaggaggggggggccaaaaaacccccggggggcatacgagagcaccctttttggaaagggcgcccaggggcgtaaaaaaagggggccggaaacgggggggaaaccgggccggggcccccgggggggggacaccgaaacgg

SEQ ID NO: 444315 - DNA, 4415 bp, Homo sapiens
ggcgacagggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgacgtatctgtcttagttccttttactccagtattcctgaagttttgctgagaacattgtgagttgttggtgttttgcccagaacatccacgtcttacagagcatgaccttggtgctaaccagatctgaagtaaggaggagcccactggtggccgtggggtgtctccttcctgcatggagctggaggatgaaggcaggctagcacagcatttagaggcactacctcttgatactgggcagatctggattttagccctactaccgacctttgtatgcctttgggcaaatgacctgccttagtcttgagctgccttgcctgtgaatgggacactaatgtgcacttcaaagtagctggaggactaaagctaatgtaggagtgtggtgaggagcccagaaaca

SEQ ID NO: 444316 - DNA, 3165 bp, Homo sapiens
ggcgacagggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcaacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgacgtatctgtcttagttccttttactccagtattcctgaagttttgctgagaacattgtgagttgttggtgttttgcccagaacatccacgtcttacagagcatgaccttggtgctaaccagatctgaagtaaggaggagcccactggtggccgtggggtgtctccttcctgcatggagctggaggatgaaggcaggctagcacagcatttagaggcactacctcttgatactgggcagatctggattttagccctactaccgacctttgtatgcctttgggcaaatgacctgccttagtcttgagctgccttgcctgtgaatgggacactaatgtgcacttcaaagtagctggaggactaaagctaatgtaggagtgtggtgaggagcccagaaaca

SEQ ID NO: 444317 - DNA, 1077 bp, Homo sapiens
acctaaagatctttgagcatcaccccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgaaaaaaaaacacacacacgaagcgacaaaagaacaaaaaaaggaggggggggccaaaaaacccccggggggcatacgagagcaccctttttggaaagggcgcccaggggcgtaaaaaaagggggccggaaacgggggggaaaccgggccggggcccccgggggggggacaccgaaacgg

SEQ ID NO: 444318 - DNA, 4275 bp, Homo sapiens
ggcgacagggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgacacgtaaaaaaaaagggggcggcaaaaaaccccggggcaatacggaccgttttggaaaggcca

SEQ ID NO: 444319 - DNA, 4206 bp, Homo sapiens
gctgtggtcacaactagggcctgggctcatgcattgaactgatctggctgaggcatcagacacggtgccagtcctgccctgcggggaagacaagagcacaaagtgacaagccagtgtggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgaaaaaaaaacacacacacgaagcgacaaaagaacaaaaaaaggaggggggggccaaaaaacccccggggggcatacgagagcaccctttttggaaagggcgcccaggggcgtaaaaaaagggggccggaaacgggggggaaaccgggccggggcccccgggggggggacaccgaaacgg

SEQ ID NO: 444320 - DNA, 4237 bp, Homo sapiens
ccgcttgcggggtgcgccctgggaccggctgtgcgtggcgttttgcccccatcgcgggctcccgcgtaacggtgtgcgttcgtgaaatcggccacgaccaagaccccagtggggagggcctgcgcgccgctcagagagaccctttcatggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgaaaaaaaaacacacacacgaagcgacaaaagaacaaaaaaaggaggggggggccaaaaaacccccggggggcatacgagagcaccctttttggaaagggcgcccaggggcgtaaaaaaagggggccggaaacgggggggaaaccgggccggggcccccgggggggggacaccgaaacgg

SEQ ID NO: 444321 - DNA, 3031 bp, Homo sapiens
ggcgacagggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgacgtatctgtcttagttccttttactccagtattcctgaagttttgctgagaacattgtgagttgttggtgttttgcccagaacatccacgtcttacagagcatgaccttggtgctaaccagatctgaagtaaggaggagcccactggtggccgtggggtgtctccttcctgcatggagctggaggatgaaggcaggctagcacagcatttagaggcactacctcttgatactgggcagatctggattttagccctactaccgacctttgtatgcctttgggcaaatgacctgccttagtcttgagctgccttgcctgtgaatgggacactaatgtgcacttcaaagtagctggaggactaaagctaatgtaggagtgtggtgaggagcccagaaaca

SEQ ID NO: 444322 - DNA, 1419 bp, Homo sapiens
  misc_feature (290)..(290): n is a, c, g, or t
ctggagtggcaacaactttcataatcagtttttctgtttcaccttcaaagatgccattaagggttcacaagaaaatgaagggaaacagaaaaactgattatgaaagttgttgcctctcctgcttcttcatacagagtgtgtatgatattgctgtgtgatgttagactgcaacttagcccaacagctgttctagtaattggcagtttctcatcgagttaagcctacctgataaagaagcacgcttacatttattgattacccccgtaaaatgaacaatacatccaacaagncttctagcaaaaatgttcttattaacctcctttttatactaaggaaaaactgggtacaacacaaatcttcatcaacagaagaataccaactgttatacagtcataaaacgatcccagaagttcactccataccatcaaaaccaggaacccacactgatgcccctgatggcagaaaatcatgatacaaaaatgagagaaacgagagagagaaaatgtactagagtcatggtagtgggtaaaagccaaagagctcagtttctactcatgatattcattagaagaaccaaaggaacatgagccaacagctgtaagggtccaggtctgcacaaggtgcctgttgggtgcagggttctgttggctccagtgatatatctcaggtgggctaatttttacggacatagccgctgcaaaaatctatcaaacaataataaagggatagctacttgcatgctaatttaccattgtatagaagggagaacaggcatcagattgttttcgtcaaataaaagcaaaaccaagatttatgaagaaaagaggaaagaggaaaaaaaatcgcctgggacctttgtgattttgctccccttggataagagacttgacagaaagctttcaaagaggtcactgtggcctgtcttcttgagacacacgacacttgttcaccacggaaaacaattacagatgttggaggactttaaaatatcctagtttagcagttcatcctatgccacagaatctgtgtgtgatgtccaccatgtccttctgtggtacaccccttcagttaagccaggagggtgcctctccgctcagtggaatatcatacatcaatgtgtagaaagtttgttgtgctggcaagtaaatgacaaaagggacattgatagaattaggaaacaaattggaatatgatctgttaccgttcccatggaagataaatttgcagaatatactcaaattagaagcattaaataaacgctgtaatttaaaatggcacatcccattctctacactacagaaatatctgcaggagtgaccaaagatatgtgtacaactatggtagagattgcagcatcagttataatcctaaaaccatgaaacccaccttatttcaaaaacatcttggtaaagaccgtcg

SEQ ID NO: 444323 - DNA, 5297 bp, Homo sapiens
  misc_feature (342)..(342): n is a, c, g, or t
  misc_feature (427)..(427): n is a, c, g, or t
  misc_feature (848)..(848): n is a, c, g, or t
  misc_feature (4168)..(4168): n is a, c, g, or t
gaattacaggcttgagccactgcgcctggcctggtctagtctccttttagagatgagaaaactgaggctcagggaggtaacctgttcaaggtcatgaactgtcttaagaccatagttgcaagtgacagagctgggtctcagatgcaacctcagacctgatactgactccagagctgtgcgcctaagcactagagcacatagcctccttgccccagggaaagaacaatgggaggttgtgggtgacctctgggtctcagggccctgggatatagggactgtgccttttttttttttttttttttgagacaaagtttcgctcttgttgcccaggctggagtgcantggcatgatctcagctcactgcaacctccgcctcccaggttcaattgattctcctgcctcagcctcccaagtagctgggattacnggcatgtgccaccacacccggctaatttttgtatttttggtggagatggggtttcgccatattgatcaggctggtctcgaactcctgacctcaggtgatccgcctgccttggcctcccaaaatgctgagattacaggtgtgagtgcccatgcctggcaggactgtgccttttgcattttcaaatgaaggaaatgagtatttcttgagtgttgaccgtgtgtccccccggcaccgtgtcatgtgctggttatgcacacacgatattctgtttcatccccggacagctctgtgagcccccaccccagagcctggagttgcagaggcagctacaggaggagcaggcctcctaccagcgcaagctgcaggcctacctggagggccagcagcggcaggcccagcttgtgtgcagcggctgcagggnaagtacaagaagaggtactcggagctggagcagcagctgctggagagatccggagagctggagcagcagcggctaagggacacagagcacagccaagacctgcagagtgccctcatccggctggaggaggagccgcagaggagtgccagcctggcccaggtgaaagccatgctccgagaacatctggaccaggcaggctcggccaaccaggctctgagtgaggacatacaaaaggtgaccaatgactggacacgcagccgcaaggagctggagcagcgggaggcggcatggaggcgcgaggaggagtctttcaatgcctacttcagcaagaagcacaatcacctgctcctgctatggaggcaggtggtggggttccggcggctggtcagcgaggtgaagatgttcaccgagagagtgacagagctgggcctggcagtgaagcgtcttcagaagcagaatccggagaaggatcaggtcaacacggacctcaccgagaagcttgaggccctgtccgtcctgtcggacacagagcggcgtccagctgagcggctccgagcgcaccgcggatgactccttcggcagcctgcgggggctctcggcccagcagaccccgtccccaccgcggcgctcctcgcccggccgaggccgttcaccccgccgaggcccctccccggcctgctcagactcctccacgctcgccctgatccactccaccttacacaagcacgagctgcaggtccaggacatgcgtgggcgctatgaggcaagccaggacctgctgggcaccctgcggaagcagcttagcgacagcgagagtgagcggcgggccctagaggaacagctgcagcgcctgcgggacaagaccgacagcaccatgcaggcccacgaggacgcccagcgcgaggtgcagcggctgcggagcgccaaagagctcctgagaagggagaagagcaacctggcccacagcctgcaggtggcccagcagcaggccaaggagctgcggcaggagcggaagaagctgcaggctgcccaggaggagctgcggcgccagcggtactggctgggggaagagcaggaggacgcagtgcaggatggtgtgcgggtgcgccgggagcttgagcgcagccatagacaactggagcagctggaagggaagcgctcagtcctggccaaggagctggtggaggtgagggaggcgctgagccgcgccacactgcaacgggacatgctgcaggccgagaaggccgaggtggccgaggcgctgaccaaggctgagggcagaggaggcctccctgcaggactccctgtccaagctgagcgccctcaacgagagccttgctcaggacaagttggatctgaaccgccttgtcacccaggccacagctggaggaagaaaagtgcgccctgcagggccggcagcggcaggcgaagcaggaggccacagtggcacgggaagagcaggagcggctggaggcgctgcggttggaacaggaggtggcgcggcagggcctggagggctccctatgagcggcggagcaggcccaggaggcagtggagcagcagctccccacgctgcatcatgagtgcagccggctgcaggagcagctagcgcagaaacaccctcaaagacacagtgagaaataatgtctaaccaaatgtctgggcacccccgacccaggcaaattgacacaaaaattaattttcacaaatactatcaatagaagtgactaataaatgtggcatcatgtcctgcctgtttatcccatgacaattagtatagtcgagcgtaacattggcttccgttcccttatagtagcaacatgtaggagtttcatttaaagtgaggataattttgaccttacagagtttctccctacccctatctaccattgccacttgtggattgtcattttgccatgactttcttttaaaaaatatcaataagctctatacttcagtaatgtaagtttgaatttcatcctggctgcataagtcactttccattttgacaaagtctagaaatatttttctccatctccttgaatatgggtaatggatacctattgtggggcccactctcaatctcatggttttattttaatttagttctcaatagatatgcctcagctgcttaaaaaccattgaaaatggcccatggccttgtccatctaacagagtccagtaaaatcctgacaatggaatggggagagagaaagtgagaaccaccaaactcagcacaaaacgactgagtttaaacctctgtgctaagagatgatcagagtctatcatggcttctagtagcatgagaccatgtctcacgaatgaccctaggctcccatgacaatgcctacctaagaaagctcaaggctgccaggggaacttactttagtctagccaatacttgatgatggcagtttcaggatctttctttcttatagcacttactaagaagggaatccttcctccatccctttgatatatgtgtgtatctcctagggacttcaatgtatctttgcccaggatctgaaaggcaatacttttgaggtgtagttctcaggaaggactgagcctctgtcttccagtctctgtgggaggttagaatcctaacttctaatattgccagctggcagacacagctgtcctgatgaggcagacatttaaaatgaccaatcttttgtaatgtttcacttgtgccctgccccctgccctctcccctgcctctctctcccattagaatgccatcacctctgcacaaatgcgaacagaaccagccccttcctctacggtcagtagttactgaataaaattggttttcatcgatttgactaatgtctgatatatctttgacaaaataagtgtgaatgattgtttttagagacacggcagctgcaaagagaggcacagacatggcaggagagggaggggtcacctgacccttctcatttcataggcatctattcctgcctggtgtttatgagcctgagacttggcagggctgtcctggtatataactccatggctctgcagcaagactcgaataggctggtggtgacacttggtgtgaccagtcaccttcaaagatgccattaagggttcacaagaaaatgaagggaaacagaaaaactgattatgaaagttgttgcctctcctgcttcttcatacagagtgtgtatgatattgctgtgtgatgttagactgcaacttagcccaacagctgttctagtaattggcagtttctcatcgagttaagcctacctgataaagaagcacgcttacatttattgattacccccgtaaaatgaacaatacatccaacaagncttctagcaaaaatgttcttattaacctcctttttatactaaggaaaaactgggtacaacacaaatcttcatcaacagaagaataccaactgttatacagtcataaaacgatcccagaagttcactccataccatcaaaaccaggaacccacactgatgcccctgatggcagaaaatcatgatacaaaaatgagagaaacgagagagagaaaatgtactagagtcatggtagtgggtaaaagccaaagagctcagtttctactcatgatattcattagaagaaccaaaggaacatgagccaacagctgtaagggtccaggtctgcacaaggtgcctgttgggtgcagggttctgttggctccagtgatatatctcaggtgggctaatttttacggacatagccgctgcaaaaatctatcaaacaataataaagggatagctacttgcatgctaatttaccattgtatagaagggagaacaggcatcagattgttttcgtcaaataaaagcaaaaccaagatttatgaagaaaagaggaaagaggaaaaaaaatcgcctgggacctttgtgattttgctccccttggataagagacttgacagaaagctttcaaagaggtcactgtggcctgtcttcttgagacacacgacacttgttcaccacggaaaacaattacagatgttggaggactttaaaatatcctagtttagcagttcatcctatgccacagaatctgtgtgtgatgtccaccatgtccttctgtggtacaccccttcagttaagccaggagggtgcctctccgctcagtggaatatcatacatcaatgtgtagaaagtttgttgtgctggcaagtaaatgacaaaagggacattgatagaattaggaaacaaattggaatatgatctgttaccgttcccatggaagataaatttgcagaatatactcaaattagaagcattaaataaacgctgtaatttaaaatggcacatcccattctctacactacagaaatatctgcaggagtgaccaaagatatgtgtacaactatggtagagattgcagcatcagttataatcctaaaaccatgaaacccaccttatttcaaaaacatcttggtaaagaccgtcg

SEQ ID NO: 444324 - DNA, 2584 bp, Homo sapiens
  misc_feature (1455)..(1455): n is a, c, g, or t
cgtcagcgcatatctaaccattgacagttgcttcgttttccaacggccttgaactggcataaacccttgctgtcaataagctctatacttcagtaatgtaagtttgaatttcatcctggctgcataagtcactttccattttgacaaagtctagaaatatttttctccatctccttgaatatgggtaatggatacctattgtggggcccactctcaatctcatggttttattttaatttagttctcaatagatatgcctcagctgcttaaaaaccattgaaaatggcccatggccttgtccatctaacagagtccagtaaaatcctgacaatggaatggggagagagaaagtgagaaccaccaaactcagcacaaaacgactgagtttaaacctctgtgctaagagatgatcagagtctatcatggcttctagtagcatgagaccatgtctcacgaatgaccctaggctcccatgacaatgcctacctaagaaagctcaaggctgccaggggaacttactttagtctagccaatacttgatgatggcagtttcaggatctttctttcttatagcacttactaagaagggaatccttcctccatccctttgatatatgtgtgtatctcctagggacttcaatgtatctttgcccaggatctgaaaggcaatacttttgaggtgtagttctcaggaaggactgagcctctgtcttccagtctctgtgggaggttagaatcctaacttctaatattgccagctggcagacacagctgtcctgatgaggcagacatttaaaatgaccaatcttttgtaatgtttcacttgtgccctgccccctgccctctcccctgcctctctctcccattagaatgccatcacctctgcacaaatgcgaacagaaccagccccttcctctacggtcagtagttactgaataaaattggttttcatcgatttgactaatgtctgatatatctttgacaaaataagtgtgaatgattgtttttagagacacggcagctgcaaagagaggcacagacatggcaggagagggaggggtcacctgacccttctcatttcataggcatctattcctgcctggtgtttatgagcctgagacttggcagggctgtcctggtatataactccatggctctgcagcaagactcgaataggctggtggtgacacttggtgtgaccagtcaccttcaaagatgccattaagggttcacaagaaaatgaagggaaacagaaaaactgattatgaaagttgttgcctctcctgcttcttcatacagagtgtgtatgatattgctgtgtgatgttagactgcaacttagcccaacagctgttctagtaattggcagtttctcatcgagttaagcctacctgataaagaagcacgcttacatttattgattacccccgtaaaatgaacaatacatccaacaagncttctagcaaaaatgttcttattaacctcctttttatactaaggaaaaactgggtacaacacaaatcttcatcaacagaagaataccaactgttatacagtcataaaacgatcccagaagttcactccataccatcaaaaccaggaacccacactgatgcccctgatggcagaaaatcatgatacaaaaatgagagaaacgagagagagaaaatgtactagagtcatggtagtgggtaaaagccaaagagctcagtttctactcatgatattcattagaagaaccaaaggaacatgagccaacagctgtaagggtccaggtctgcacaaggtgcctgttgggtgcagggttctgttggctccagtgatatatctcaggtgggctaatttttacggacatagccgctgcaaaaatctatcaaacaataataaagggatagctacttgcatgctaatttaccattgtatagaagggagaacaggcatcagattgttttcgtcaaataaaagcaaaaccaagatttatgaagaaaagaggaaagaggaaaaaaaatcgcctgggacctttgtgattttgctccccttggataagagacttgacagaaagctttcaaagaggtcactgtggcctgtcttcttgagacacacgacacttgttcaccacggaaaacaattacagatgttggaggactttaaaatatcctagtttagcagttcatcctatgccacagaatctgtgtgtgatgtccaccatgtccttctgtggtacaccccttcagttaagccaggagggtgcctctccgctcagtggaatatcatacatcaatgtgtagaaagtttgttgtgctggcaagtaaatgacaaaagggacattgatagaattaggaaacaaattggaatatgatctgttaccgttcccatggaagataaatttgcagaatatactcaaattagaagcattaaataaacgctgtaatttaaaatggcacatcccattctctacactacagaaatatctgcaggagtgaccaaagatatgtgtacaactatggtagagattgcagcatcagttataatcctaaaaccatgaaacccaccttatttcaaaaacatcttggtaaagaccgtcg

SEQ ID NO: 444325 - DNA, 451 bp, Homo sapiens
aaagcatagagacaaaacccggcaactggcatataatactgtattagtctgagttatccagaggacaagatacacacacacacacacacacacacacacacacacacacgcatgcacgcacgcagagaagcccaagttctactctgagtaagctctatacctaggagagtcgaatatagttcaagaccaagtccaaggcttaaggcagaagactgatgtcccagctcaaagacagtggagcagaaacctttcttaacccatcatcttattcaagccgtccatgggttggatgaggcccacccacactcgggagggcaatctgcttcactcagtttactgattcaaatgtcaatctcttccagaaacaccctcaaagacacagtgagaaataatgtctaaccaaatgtctgggcacccccgacccaggcaaattgacacaaaaattaatttt

SEQ ID NO: 444326 - DNA, 5510 bp, Homo sapiens
  misc_feature (342)..(342): n is a, c, g, or t
  misc_feature (427)..(427): n is a, c, g, or t
  misc_feature (848)..(848): n is a, c, g, or t
  misc_feature (1245)..(1245): n is a, c, g, or t
  misc_feature (4381)..(4381): n is a, c, g, or t
gaattacaggcttgagccactgcgcctggcctggtctagtctccttttagagatgagaaaactgaggctcagggaggtaacctgttcaaggtcatgaactgtcttaagaccatagttgcaagtgacagagctgggtctcagatgcaacctcagacctgatactgactccagagctgtgcgcctaagcactagagcacatagcctccttgccccagggaaagaacaatgggaggttgtgggtgacctctgggtctcagggccctgggatatagggactgtgccttttttttttttttttttttgagacaaagtttcgctcttgttgcccaggctggagtgcantggcatgatctcagctcactgcaacctccgcctcccaggttcaattgattctcctgcctcagcctcccaagtagctgggattacnggcatgtgccaccacacccggctaatttttgtatttttggtggagatggggtttcgccatattgatcaggctggtctcgaactcctgacctcaggtgatccgcctgccttggcctcccaaaatgctgagattacaggtgtgagtgcccatgcctggcaggactgtgccttttgcattttcaaatgaaggaaatgagtatttcttgagtgttgaccgtgtgtccccccggcaccgtgtcatgtgctggttatgcacacacgatattctgtttcatccccggacagctctgtgagcccccaccccagagcctggagttgcagaggcagctacaggaggagcaggcctcctaccagcgcaagctgcaggcctacctggagggccagcagcggcaggcccagcttgtgtgcagcggctgcagggnaagtacaagaagaggtactcggagctggagcagcagctgctggagagatccggagagctggagcagcagcggctaagggacacagagcacagccaagacctgcagagtgccctcatccggctggaggaggagccgcagaggagtgccagcctggcccaggtgaaagccatgctccgagaacatctggaccaggcaggctcggccaaccaggctctgagtgaggacatacaaaaggtgaccaatgactggacacgcagccgcaaggagctggagcagcgggaggcggcatggaggcgcgaggaggaggacctgctgcagctgggaggggagctggcccggacatcacgagctgtccaggaggcgggcctgggactgagcacgggcctgtggctggcanagagccgggccaaggcagccctggagaagcaggccctgctgcaggcccagctggaggagcagctgcgggacaaggtgctccactagaaggacctggcccagcagcagatgcaaagtgacctggacaaggctgacctcagtgccagagtgacagagctgggcctggcagtgaagcgtcttcagaagcagaatccggagaaggatcaggtcaacacggacctcaccgagaagcttgaggccctggaatccctgcggctacaggagcaggtggccctggagacagaggacggagaggggctacagcagagcctaagggacctggcacagtccgtcctgtcggacacagagcggcgtccagctgagcggctccgagcgcaccgcggatgactccttcggcagcctgcgggggctctcggcccagcagaccccgtccccaccgcggcgctcctcgcccggccgaggccgttcaccccgccgaggcccctccccggcctgctcagactcctccacgctcgccctgatccactccaccttacacaagcacgagctgcaggtccaggacatgcgtgggcgctatgaggcaagccaggacctgctgggcaccctgcggaagcagcttagcgacagcgagagtgagcggcgggccctagaggaacagctgcagcgcctgcgggacaagaccgacagcaccatgcaggcccacgaggacgcccagcgcgaggtgcagcggctgcggagcgccaaagagctcctgagaagggagaagagcaacctggcccacagcctgcaggtggcccagcagcaggccaaggagctgcggcaggagcggaagaagctgcaggctgcccaggaggagctgcggcgccagcggtactggctgggggaagagcaggaggacgcagtgcaggatggtgtgcgggtgcgccgggagcttgagcgcagccatagacaactggagcagctggaagggaagcgctcagtcctggccaaggagctggtggaggtgagggaggcgctgagccgcgccacactgcaacgggacatgctgcaggccgagaaggccgaggtggccgaggcgctgaccaaggctgagggcagaggaggcctccctgcaggactccctgtccaagctgagcgccctcaacgagagccttgctcaggacaagttggatctgaaccgccttgtcacccaggccacagctggaggaagaaaagtgcgccctgcagggccggcagcggcaggcgaagcaggaggccacagtggcacgggaagagcaggagcggctggaggcgctgcggttggaacaggaggtggcgcggcagggcctggagggctccctatgagcggcggagcaggcccaggaggcagtggagcagcagctccccacgctgcatcatgagtgcagccggctgcaggagcagctagcgcagaaacaccctcaaagacacagtgagaaataatgtctaaccaaatgtctgggcacccccgacccaggcaaattgacacaaaaattaattttcacaaatactatcaatagaagtgactaataaatgtggcatcatgtcctgcctgtttatcccatgacaattagtatagtcgagcgtaacattggcttccgttcccttatagtagcaacatgtaggagtttcatttaaagtgaggataattttgaccttacagagtttctccctacccctatctaccattgccacttgtggattgtcattttgccatgactttcttttaaaaaatatcaataagctctatacttcagtaatgtaagtttgaatttcatcctggctgcataagtcactttccattttgacaaagtctagaaatatttttctccatctccttgaatatgggtaatggatacctattgtggggcccactctcaatctcatggttttattttaatttagttctcaatagatatgcctcagctgcttaaaaaccattgaaaatggcccatggccttgtccatctaacagagtccagtaaaatcctgacaatggaatggggagagagaaagtgagaaccaccaaactcagcacaaaacgactgagtttaaacctctgtgctaagagatgatcagagtctatcatggcttctagtagcatgagaccatgtctcacgaatgaccctaggctcccatgacaatgcctacctaagaaagctcaaggctgccaggggaacttactttagtctagccaatacttgatgatggcagtttcaggatctttctttcttatagcacttactaagaagggaatccttcctccatccctttgatatatgtgtgtatctcctagggacttcaatgtatctttgcccaggatctgaaaggcaatacttttgaggtgtagttctcaggaaggactgagcctctgtcttccagtctctgtgggaggttagaatcctaacttctaatattgccagctggcagacacagctgtcctgatgaggcagacatttaaaatgaccaatcttttgtaatgtttcacttgtgccctgccccctgccctctcccctgcctctctctcccattagaatgccatcacctctgcacaaatgcgaacagaaccagccccttcctctacggtcagtagttactgaataaaattggttttcatcgatttgactaatgtctgatatatctttgacaaaataagtgtgaatgattgtttttagagacacggcagctgcaaagagaggcacagacatggcaggagagggaggggtcacctgacccttctcatttcataggcatctattcctgcctggtgtttatgagcctgagacttggcagggctgtcctggtatataactccatggctctgcagcaagactcgaataggctggtggtgacacttggtgtgaccagtcaccttcaaagatgccattaagggttcacaagaaaatgaagggaaacagaaaaactgattatgaaagttgttgcctctcctgcttcttcatacagagtgtgtatgatattgctgtgtgatgttagactgcaacttagcccaacagctgttctagtaattggcagtttctcatcgagttaagcctacctgataaagaagcacgcttacatttattgattacccccgtaaaatgaacaatacatccaacaagncttctagcaaaaatgttcttattaacctcctttttatactaaggaaaaactgggtacaacacaaatcttcatcaacagaagaataccaactgttatacagtcataaaacgatcccagaagttcactccataccatcaaaaccaggaacccacactgatgcccctgatggcagaaaatcatgatacaaaaatgagagaaacgagagagagaaaatgtactagagtcatggtagtgggtaaaagccaaagagctcagtttctactcatgatattcattagaagaaccaaaggaacatgagccaacagctgtaagggtccaggtctgcacaaggtgcctgttgggtgcagggttctgttggctccagtgatatatctcaggtgggctaatttttacggacatagccgctgcaaaaatctatcaaacaataataaagggatagctacttgcatgctaatttaccattgtatagaagggagaacaggcatcagattgttttcgtcaaataaaagcaaaaccaagatttatgaagaaaagaggaaagaggaaaaaaaatcgcctgggacctttgtgattttgctccccttggataagagacttgacagaaagctttcaaagaggtcactgtggcctgtcttcttgagacacacgacacttgttcaccacggaaaacaattacagatgttggaggactttaaaatatcctagtttagcagttcatcctatgccacagaatctgtgtgtgatgtccaccatgtccttctgtggtacaccccttcagttaagccaggagggtgcctctccgctcagtggaatatcatacatcaatgtgtagaaagtttgttgtgctggcaagtaaatgacaaaagggacattgatagaattaggaaacaaattggaatatgatctgttaccgttcccatggaagataaatttgcagaatatactcaaattagaagcattaaataaacgctgtaatttaaaatggcacatcccattctctacactacagaaatatctgcaggagtgaccaaagatatgtgtacaactatggtagagattgcagcatcagttataatcctaaaaccatgaaacccaccttatttcaaaaacatcttggtaaagaccgtcg

SEQ ID NO: 444327 - DNA, 730 bp, Homo sapiens
gaagcactgggaggtcttctcagtaacaacactaaagtaattgctatttttccagcctgtggaaccacagaagtgactgtaactaaaattagacatttctttctgattcattctctactcacgggattgtcagaccccagtcttcttctggactctataaactttttagaaatcatcagcaggctcctggagaagcttaaatgaactcacacaatatgtgacagtgaactccctgggagagtgaaaaccaaagtctaagccagtgtctccatttacttgtgtgattgtgggcaagtcattcaagtgctttgaggctcaggtcttaattcatgaaatggaggtaataataccttgttggcagacctcacttggttaaaatgataatgttgatagttacaatagttacatttaattgatcaattgttttatgcaagggctttatttgtgctatctcagtttgtcacatcaatgaattagaaagatacgaaagtatttccaatttacaaatgaggagtctgagtctgggagtcattctgtcatgtgtccactgtcacctgctcattggtggcagcactgagattaggatctaagtccacttcaccgcagaagcagggcttctaaatactgttctatggcaagagcaccctgctctcacaaaatgcataaaacttcctatctcaccattataattttgactgatattaaacaaagagaagtattattattatta

SEQ ID NO: 444328 - DNA, 4964 bp, Homo sapiens
agaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatc

SEQ ID NO: 444329 - DNA, 5783 bp, Homo sapiens
agaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaacaataactaacaataaaattgaatagttataataatatattgtaataaaagttatgtgaatgtgatctctttctttctctctctcaaaatatcttactgtactgtactcacctgctcattggtggcagcactgagattaggatctaagtccacttcaccgcagaagcagggcttctaaatactgttctatggcaagagcaccctgctctcacaaaatgcataaaacttcctatctcaccattataattttgactgatattaaacaaagagaagtattattattatta

SEQ ID NO: 444330 - DNA, 4677 bp, Homo sapiens
agaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatc

SEQ ID NO: 444331 - DNA, 4844 bp, Homo sapiens
agaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatc

SEQ ID NO: 444332 - DNA, 5699 bp, Homo sapiens
agaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaacaataactaacaataaaattgaatagttataataatatattgtaataaaagttatgtgaatgtgatctctttctttctctctctcaaaatatcttactgtactgtactcacctattttcagaccataactgaccatgaaacctgggaaagtgaaactgtggataagtgaggaactaacatacatacatgattgtttatctaca

SEQ ID NO: 444333 - DNA, 376 bp, Homo sapiens
ccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtatgtggctggagtcagctcctctgaactttccctcacttctgcccagaacttctcactgtgtgccctggtttgtttatttttgca

SEQ ID NO: 444334 - DNA, 467 bp, Homo sapiens
agaaaaaacgggtggcggagtcggtgggggaggtgggtgggagtgtgggtgggacacaaagaataacaccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccaaaaaatgtg

SEQ ID NO: 444335 - DNA, 4842 bp, Homo sapiens
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagggcctcatagcatctcattcaattacaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccaaaaaatgtg

SEQ ID NO: 444336 - DNA, 5910 bp, Homo sapiens
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggaggtaaggctggaagcaggaggggcgggaaggcccaggagtttgttgggtctcagcagtgtcagacaagagactgaattcaccaagtgcatactggcaggccagcccatcctgctgtctcgctgtcggccagcgttttacagccctgcatgggcaccactgatcagagaatctcatacaaaaaccagtggaggccgggcgcagtggctcacgcctgtcatcccagcagtttgggaggccgaggcgggtggatcacttgaggccaggagtttgagaccagcctggccaacatggcgaaaccccgcctctactaaaaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagggcctcatagcatctcattcaattacaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccaaaaaatgtg

SEQ ID NO: 444337 - DNA, 6226 bp, Homo sapiens
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggaggtaaggctggaagcaggaggggcgggaaggcccaggagtttgttgggtctcagcagtgtcagacaagagactgaattcaccaagtgcatactggcaggccagcccatcctgctgtctcgctgtcggccagcgttttacagccctgcatgggcaccactgatcagagaatctcatacaaaaaccagtggaggccgggcgcagtggctcacgcctgtcatcccagcagtttgggaggccgaggcgggtggatcacttgaggccaggagtttgagaccagcctggccaacatggcgaaaccccgcctctactaaaaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacggtacgggtgtgggtgttaggggacgggatcaggactagcgggctccccacctgcaagaggaaggggcaccttggctgtatttctcttttgtccaacaaaccctaactcagcctcaggtgatcccttgatgggggagatggccatgggcacccccacccaagcaagggacccaggtgtctcctcggggcccattggactggggcatggagaacagagtcccggctgtgtgagcagcccaaggaaggcagcattccaacctcttcttccctgggaacggtccacagtgcctcactcgcatgtcctctcctccccacagtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagggcctcatagcatctcattcaattacaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccaaaaaatgtg

SEQ ID NO: 444338 - DNA, 5619 bp, Homo sapiens
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggaggtaaggctggaagcaggaggggcgggaaggcccaggagtttgttgggtctcagcagtgtcagacaagagactgaattcaccaagtgcatactggcaggccagcccatcctgctgtctcgctgtcggccagcgttttacagccctgcatgggcaccactgatcagagaatctcatacaaaaaccagtggaggccgggcgcagtggctcacgcctgtcatcccagcagtttgggaggccgaggcgggtggatcacttgaggccaggagtttgagaccagcctggccaacatggcgaaaccccgcctctactaaaaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacggtacgggtgtgggtgttaggggacgggatcaggactagcgggctccccacctgcaagaggaaggggcaccttggctgtatttctcttttgtccaacaaaccctaactcagcctcaggtgatcccttgatgggggagatggccatgggcacccccacccaagcaagggacccaggtgtctcctcggggcccattggactggggcatggagaacagagtcccggctgtgtgagcagcccaaggaaggcagcattccaacctcttcttccctgggaacggtccacagtgcctcactcgcatgtcctctcctccccacagtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagggcctcatagcatctcattcaattacaagaatagaggccagacacggtggcgcatgcctgtagtcccagctaactggggccacaggtgtgtgccaccatgctcagctaatttttttatttttggtagagactgggtctccatgttacccagactggtcttgaactcctgagctcgggcgatccacccacttcagcctcccaaagtgctggattgcagcatgacccactgtgcctggccctagagatgctatctctt

SEQ ID NO: 444339 - DNA, 4866 bp, Homo sapiens
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggaggtaaggctggaagcaggaggggcgggaaggcccaggagtttgttgggtctcagcagtgtcagacaagagactgaattcaccaagtgcatactggcaggccagcccatcctgctgtctcgctgtcggccagcgttttacagccctgcatgggcaccactgatcagagaatctcatacaaaaaccagtggaggccgggcgcagtggctcacgcctgtcatcccagcagtttgggaggccgaggcgggtggatcacttgaggccaggagtttgagaccagcctggccaacatggcgaaaccccgcctctactaaaaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccttcctctttacgagggatcctctagaacagct

SEQ ID NO: 444340 - DNA, 4771 bp, Homo sapiens
  misc_feature (4602)..(4602): n is a, c, g, or t
  misc_feature (4608)..(4608): n is a, c, g, or t
  misc_feature (4616)..(4617): n is a, c, g, or t
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggaggtaaggctggaagcaggaggggcgggaaggcccaggagtttgttgggtctcagcagtgtcagacaagagactgaattcaccaagtgcatactggcaggccagcccatcctgctgtctcgctgtcggccagcgttttacagccctgcatgggcaccactgatcagagaatctcatacaaaaaccagtggaggccgggcgcagtggctcacgcctgtcatcccagcagtttgggaggccgaggcgggtggatcacttgaggccaggagtttgagaccagcctggccaacatggcgaaaccccgcctctactaaaaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagcccaatctcctaatcaagntgcccntgttccannggtctgcccggtcgattgcgaccgcacctagtccgcggtagttaccattataagccttgggagctggtggagcggaacacaatatcgtcgtaggtcaccgtatttgaggggatacaacctttaaagggaggcggccacgttagaacgatctgtt

SEQ ID NO: 444341 - DNA, 427 bp, Homo sapiens
aaacctggaaccctatatgaatctgcatttctgatcagcccccattgtgggtctagggctaacggccatcagtgctttttctctgcttgaacaggtagaagcccccaaagttgtccattggccatgcccctgtgagggcatgagccagaagtgagggcagtttgtttttcagtgatacttcagagagggccatttgagatgggctctgaggtaagcataggagttcaccagacgcagaaggaggtcacaacctgggctgggttcagtaggtgggttccagattatccccaccccaacctgggctgggttcggcaagtggggtccaggctcctcactcccccttgctgctcttggttgacaggagagtaacaacatggtggtgcctgccatgcagctcgccagcaagatcccggacatgtcggtacag

SEQ ID NO: 444342 - DNA, 103 bp, Homo sapiens
ctttttcgcagtgtctgtacttccttaactggttgatatcacagcaaatcccacagttcgaagatgttaaatttgaagcagcaagtctgttgtctgaattgta

SEQ ID NO: 444343 - DNA, 5002 bp, Homo sapiens
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagggcctcatagcatctcattcaattacaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccaaaaaatgtg

SEQ ID NO: 444344 - DNA, 4917 bp, Homo sapiens
  misc_feature (34)..(34): n is a, c, g, or t
tggtgatctagaggatctgggctcccacttggtngccaaggagcacatgtgtggtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggaggtaaggctggaagcaggaggggcgggaaggcccaggagtttgttgggtctcagcagtgtcagacaagagactgaattcaccaagtgcatactggcaggccagcccatcctgctgtctcgctgtcggccagcgttttacagccctgcatgggcaccactgatcagagaatctcatacaaaaaccagtggaggccgggcgcagtggctcacgcctgtcatcccagcagtttgggaggccgaggcgggtggatcacttgaggccaggagtttgagaccagcctggccaacatggcgaaaccccgcctctactaaaaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagggcctcatagcatctcattcaattacaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccaaaaaatgtg

SEQ ID NO: 444345 - DNA, 4909 bp, Homo sapiens
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggaggtaaggctggaagcaggaggggcgggaaggcccaggagtttgttgggtctcagcagtgtcagacaagagactgaattcaccaagtgcatactggcaggccagcccatcctgctgtctcgctgtcggccagcgttttacagccctgcatgggcaccactgatcagagaatctcatacaaaaaccagtggaggccgggcgcagtggctcacgcctgtcatcccagcagtttgggaggccgaggcgggtggatcacttgaggccaggagtttgagaccagcctggccaacatggcgaaaccccgcctctactaaaaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaa

SEQ ID NO: 444346 - DNA, 5888 bp, Homo sapiens
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccacagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtctgcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggaggtaaggctggaagcaggaggggcgggaaggcccaggagtttgttgggtctcagcagtgtcagacaagagactgaattcaccaagtgcatactggcaggccagcccatcctgctgtctcgctgtcggccagcgttttacagccctgcatgggcaccactgatcagagaatctcatacaaaaaccagtggaggccgggcgcagtggctcacgcctgtcatcccagcagtttgggaggccgaggcgggtggatcacttgaggccaggagtttgagaccagcctggccaacatggcgaaaccccgcctctactaaaaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagggcctcatagcatctcattcaattacaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccaaaaaatgtg

SEQ ID NO: 444347 - DNA, 360 bp, Homo sapiens
ttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctggtgagtaaccctgtgacaacaccccgggagaatccagaatgttctcagtaagtaagtac

SEQ ID NO: 444348 - DNA, 2879 bp, Homo sapiens
gctgcaacatagctctgtaccatctgggatgctagcagtcacagcagttagctcagatatctgagctgtctgccacacaaagcctgaggagatcatcattcttcagtttcattcattacttaatgaatgccaaattaattggcaggaagaagaaacactgtgtgatatactgaacaagcctgtgtgcatgaataaggagccactcaaaaagccaattttgagctttatttctccgttgttaacaaatctcaagaaagcctttgttacagtttagctcatgtcatttggttggttttattttctagccctttaacataggaggaaaattgtcatttcatgtataacttgtaacacagaattgaactgatactagtttccttgccttaaattaattatatgtcatcccaagggtctctgttaattctgctttgccaagcaataatgagatctgggtttggcattagaagtatttcataattttggttttttatttaggtttcctccacatctgtaaagtgattgattaaattagaggaggcgtgtagaataaatcccaatcccattgcaactggcagagctttataaatctttataaattcagttacaacaaaggagaggatcctacaccattagagccatgccatcaggtgtttgcaagtgacagctgtagtgtgttgcctcaaataataccaagttataaataataccaagtaattatcaactcactcccaaatttaataagatatcaaagtccaaaaggttacttaggagtagtcttccgtgggggaagataaatttattaaagagtcatgtactgatctttttcttgggattttttttcctttcccagaaaaaaaaattattttggtgactgatcaattgtaaacaattttcttccttacttacaaatcatccgttcagaaaaataaaagtggacttcctttcctaagcattacaattagcctgggcaagaggtgttatgattgtcttattctttaagccggcttactttttggatttgtgtgaaatgtcttttgaaaagaaagtagatagtatagtattaattaactactttgtatagtcttctgcataatttagagttgaaaataatgtaacattttcctgtgaacagattcctttatgcgtacatactttataaatatacatacatacacatacacatacatttttaaaatgctctttttaaagagattcttatcttgctcccactccaaaagctatgtacagttgagttattagcctcagaggaagagtacaggaaagcgaagatgaggacctccttttcttgtgttggtcttgggaacaaacagtattccgtctttcaaatatggcatatttctaaacagtttgggaaagatgttagaattttttaaaagtcagctcttttataaattggaagtactcagtagtcagaaattaagatcccctctgatagagatagattctcaaaaccaaaattggactgaaaattagattgagaagaaagatacaacttcctccatagccaataaaatctgtctttccaagtctgcttattaatgctgtgaatcgctccttctgtttgtgaaaacatctcctggactggaaatgtggtgctgtaaccagctgagccgaaagttggagaatgttaaatatcttatatgggacttacgataaaatgtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaactgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttcttatagtacaaataattttcagatcccagctttggtaaatgtgttaattctactttgtgaataaataaatgagtgatctgctaaaaatggcaattgtagaattatgttgtatgtaatgtacatatggagaaagaatgtattttgttcattttcttaataaaatgttatatatggatgcta

SEQ ID NO: 444349 - DNA, 2469 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagtt

SEQ ID NO: 444350 - DNA, 2781 bp, Homo sapiens
gctgcaacatagctctgtaccatctgggatgctagcagtcacagcagttagctcagatatctgagctgtctgccacacaaagcctgaggagatcatcattcttcagtttcattcattacttaatgaatgccaaattaattggcaggaagaagaaacactgtgtgatatactgaacaagcctgtgtgcatgaataaggagccactcaaaaagccaattttgagctttatttctccgttgttaacaaatctcaagaaagcctttgttacagtttagctcatgtcatttggttggttttattttctagccctttaacataggaggaaaattgtcatttcatgtataacttgtaacacagaattgaactgatactagtttccttgccttaaattaattatatgtcatcccaagggtctctgttaattctgctttgccaagcaataatgagatctgggtttggcattagaagtatttcataattttggttttttatttaggtttcctccacatctgtaaagtgattgattaaattagaggaggcgtgtagaataaatcccaatcccattgcaactggcagagctttataaatctttataaattcagttacaacaaaggagaggatcctacaccattagagccatgccatcaggtgtttgcaagtgacagctgtagtgtgttgcctcaaataataccaagttataaataataccaagtaattatcaactcactcccaaatttaataagatatcaaagtccaaaaggttacttaggagtagtcttccgtgggggaagataaatttattaaagagtcatgtactgatctttttcttgggattttttttcctttcccagaaaaaaaaattattttggtgactgatcaattgtaaacaattttcttccttacttacaaatcatccgttcagaaaaataaaagtggacttcctttcctaagcattacaattagcctgggcaagaggtgttatgattgtcttattctttaagccggcttactttttggatttgtgtgaaatgtcttttgaaaagaaagtagatagtatagtattaattaactactttgtatagtcttctgcataatttagagttgaaaataatgtaacattttcctgtgaacagattcctttatgcgtacatactttataaatatacatacatacacatacacatacatttttaaaatgctctttttaaagagattcttatcttgctcccactccaaaagctatgtacagttgagttattagcctcagaggaagagtacaggaaagcgaagatgaggacctccttttcttgtgttggtcttgggaacaaacagtattccgtctttcaaatatggcatatttctaaacagtttgggaaagatgttagaattttttaaaagtcagctcttttataaattggaagtactcagtagtcagaaattaagatcccctctgatagagatagattctcaaaaccaaaattggactgaaaattagattgagaagaaagatacaacttcctccatagccaataaaatctgtctttccaagtctgcttattaatgctgtgaatcgctccttctgtttgtgaaaacatctcctggactggaaatgtggtgctgtaaccagctgagccgaaagttggagaatgttaaatatcttatatgggacttacgataaaatgtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaactgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttcttatagtacaaataattttcagatcccagctttggtaaatgtgttaattctactttgtgaataaataaatgagtgatctgct

SEQ ID NO: 444351 - DNA, 777 bp, Homo sapiens
tggttcagaagcattaacaagtcagaaaagacaagtggaatttcctcagtggaccagcagagaaaagacctaataaggaaaaaaagagagatcagtattatttgtaactaaagtgccagtccttctgctagacgcttttcatgtaactacatttaatctgcacaataactgtatgaagtaaacaggattatcacatacttacagctgaggaagcaaagtctgaaagccagaaagtctgactaatttatctaagatcacaccacagccaggtagtagaactggggtcagatcagtagtgtctgcctggttttgaagcctgatttgatttctccattataaaatacattgctgctggtctcaactagtttttctgttacatgttttaaacacaatggatgtttctttgtatcttcttcaccaggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagtt

SEQ ID NO: 444352 - DNA, 206 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgaccgcagtggctcaggcctgttgtctggtgcataaggaggcgaggctaggcgttcgaggctagcctgggcaacacagaaacc

SEQ ID NO: 444353 - DNA, 1224 bp, Homo sapiens
  misc_feature (2)..(2): n is a, c, g, or t
  misc_feature (25)..(25): n is a, c, g, or t
anttgcggaacaggcctcgtgcgtngtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaactgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttcttatagtacaaataattttcagatcccagctttggtaaatgtgttaattctactttgtgaataaataaatgagtgatctgctaaaaatggcaattgtagaattatgttgtatgtaatgtacatatggagaaagaatgtattttgttcattttcttaataaaatgttatatatggatgcta

SEQ ID NO: 444354 - DNA, 1065 bp, Homo sapiens
ggatggcttcagccaaagaggcagaggttgcggtgagccaggatcgcacaactgcactccaaattgggcaacagagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaactgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttcttatagtacaaataattttcagatcccagctttggtaaatgtgttaattctactttgtgaataaataaatgagtgatctgctaaaaatggcaattgtagaattatgttgtatgtaatgtacatatggagaaagaatgtattttgttcattttcttaataaaatgttatatatggatgcta

SEQ ID NO: 444355 - DNA, 2784 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagttaaatatatatatatatatattttttcttactttatcttttaagaattaatgagtataaaagaaaaattaggcagtttacccttttcagatttttatttcttttttttttaattgggggaaataagcactattaacagattcagcactacaagtattttgaatgttgttgctgttggtcatttggcctgccttttcccttcctatttcactttgcctcccatcacacaactgcgtgtaaatggtgtcacttgttcacctctttacttcattcttaacaagtgtatagttctctaggacagttgatgtatgttaagg

SEQ ID NO: 444356 - DNA, 2393 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctggcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagtt

SEQ ID NO: 444357 - DNA, 2685 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagaggcatccttgttcatctagcaatatctgaactgcagtgcatttgccttccactcacagaattcgtgctgattatatgtagttctgacccttaggtctctttccgtgttagctcctgccttgctttggctttgtaatagcagtatcaagctgtgcccggcatgcttgagcattgacacaggtgtcagatttaatgttgaatcactttcaggctccaggttcattgtactttcaagcaatagaggctgcatgtcttcagcaccataacaaagagatactctttcatagtttcgtactataaaattaagtcctaagtctctcaatattgattatggcccttcagtaggtagagaatctgcaggacatgctttagaacccccatgaagggggacagttaattgtctttccttgagttttcagtcaattcatgacactgtgcaaataggagaaataattatagttttgccaagtggcagaatatgtttgatttaatcttttatgacttataactgtacttagttgtgaagagtccattaatgttaattttgttatgccatgcatttgagagttatgcatagatttccttgtattttctccatattctatgtaaaatagctgtaactgggaaca

SEQ ID NO: 444358 - DNA, 1036 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccctcatgatctctggcttatcttttatccaatctgtatggactttttaggattttttttttcttatagtacaaataattttcagatcccagctttggtaaatgtgttaattctactttgtgaataaataaatgagtgatctgctaaaaatggcaattgtagaattatgttgtatgtaatgtacatatggagaaagaatgtattttgttcattttcttaataaaatgttatatatggatgcta

SEQ ID NO: 444359 - DNA, 318 bp, Homo sapiens
gaacattttagtggacaaaccaaatgaccaatcttcaagatggtcttcagagagcaactatcctccccaggtaagattacatgtatcccttaatgctgtttagaagtcaccatttaaataaacactcaattgatactagttatctggaatctactaatagtttattctctttttgagattgtgaggtaaatttttattctctctatttttgcttgtttattaaattttggaagaatttttatctcataggcaaatgcagtgtgagatttgatgaaacatggacttttacttctgtctaccagaacagttacgctcaag

SEQ ID NO: 444360 - DNA, 2434 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataatttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagtt

SEQ ID NO: 444361 - DNA, 2564 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagttgaacaattttaatgcattgacaagtgaacctcgagggggggcccggaccccaattctgcctatagtgagtggaattacaatttactggccggctt

SEQ ID NO: 444362 - DNA, 2491 bp, Homo sapiens
ggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagaggtaaagaaaggtggtaataaatttcagaaattaagtatttttaaatgtcttcctaacttatatttaatgattttgctcttgagtgtgtaaaggaaaacgaagaaaatatgatgacatcagtaatctttaaaatgtcacagagcaggtgaaataaaaattgaataggcatgttttcgtgtgataagattcaagtcaccaaaaacccttggtccattcagaaaaggattatcaggtataaagttttaacttagttttgtgttttggaaagcaaatagaaatttttactttgtccatagtcccatgattattttacttaaggattacataatggttcaatataaacttttctgtggatagttaagatcccccaagagaggaaagaaaactcccctgttgcttagggagaaaatgaagagaggttggtgggagttag

SEQ ID NO: 444363 - DNA, 4403 bp, Homo sapiens
ttgggcggcggcgcggagcgggcggcgagctgtgcgggaggggcggccccgaggggcggggcgggccgacgccgcgtgtcccgccgcagccgcggagtccggctcctagatggggcccggcgcgtagaggtgcctcccgctcgttgccgcgtcctacccgcaccgtgcgcggctcgagctgaggacaccaacggccgcgactccccggcgagaccaggccggagcgtggacggcgcgcgcgccccgcgagggagggcgctgaggcgcgcgccggaagcgggagcgggagcgggagcgcggcggcggcggcgaaggtgcgggcggccgagcggggggcggggctgcggtgcctgcagaaccttggacagaagctccctagctgccgccgccgccgccgccgccgtcgccgccgccgagcgcgagcccagccgatccccgccgagcgcccccgagcgccgccgagcgccgggaccgcggcggcggggccgcggcgcgcattgcggagggcgcggagcgcaggagctgccgcctgccgggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccattaaaaaaaaacacaacaaaaacaaaagcagaaatactatatgtctacattttaaaatcagaattagtatatatacttacacacatact

SEQ ID NO: 444364 - DNA, 4157 bp, Homo sapiens
ttgggcggcggcgcggagcgggcggcgagctgtgcgggaggggcggccccgaggggcggggcgggccgacgccgcgtgtcccgccgcagccgcggagtccggctcctagatggggcccggcgcgtagaggtgcctcccgctcgttgccgcgtcctacccgcaccgtgcgcggctcgagctgaggacaccaacggccgcgactccccggcgagaccaggccggagcgtggacggcgcgcgcgccccgcgagggagggcgctgaggcgcgcgccggaagcgggagcgggagcgggagcgcggcggcggcggcgaaggtgcgggcggccgagcggggggcggggctgcggtgcctgcagaaccttggacagaagctccctagctgccgccgccgccgccgccgccgtcgccgccgccgagcgcgagcccagccgatccccgccgagcgcccccgagcgccgccgagcgccgggaccgcggcggcggggccgcggcgcgcattgcggagggcgcggagcgcaggagctgccgcctgccgggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctggggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccatta

SEQ ID NO: 444365 - DNA, 1320 bp, Homo sapiens
gcattcccagaggtggggaagagagcctgcccggccggagaacatctgcctcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccatta

SEQ ID NO: 444366 - DNA, 4317 bp, Homo sapiens
ttgggcggcggcgcggagcgggcggcgagctgtgcgggaggggcggccccgaggggcggggcgggccgacgccgcgtgtcccgccgcagccgcggagtccggctcctagatggggcccggcgcgtagaggtgcctcccgctcgttgccgcgtcctacccgcaccgtgcgcggctcgagctgaggacaccaacggccgcgactccccggcgagaccaggccggagcgtggacggcgcgcgcgccccgcgagggagggcgctgaggcgcgcgccggaagcgggagcgggagcgggagcgcggcggcggcggcgaaggtgcgggcggccgagcggggggcggggctgcggtgcctgcagaaccttggacagaagctccctagctgccgccgccgccgccgccgccgtcgccgccgccgagcgcgagcccagccgatccccgccgagcgcccccgagcgccgccgagcgccgggaccgcggcggcggggccgcggcgcgcattgcggagggcgcggagcgcaggagctgccgcctgccgggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccatta

SEQ ID NO: 444367 - DNA, 4264 bp, Homo sapiens
ttgggcggcggcgcggagcgggcggcgagctgtgcgggaggggcggccccgaggggcggggcgggccgacgccgcgtgtcccgccgcagccgcggagtccggctcctagatggggcccggcgcgtagaggtgcctcccgctcgttgccgcgtcctacccgcaccgtgcgcggctcgagctgaggacaccaacggccgcgactccccggcgagaccaggccggagcgtggacggcgcgcgcgccccgcgagggagggcgctgaggcgcgcgccggaagcgggagcgggagcgggagcgcggcggcggcggcgaaggtgcgggcggccgagcggggggcggggctgcggtgcctgcagaaccttggacagaagctccctagctgccgccgccgccgccgccgccgtcgccgccgccgagcgcgagcccagccgatccccgccgagcgcccccgagcgccgccgagcgccgggaccgcggcggcggggccgcggcgcgcattgcggagggcgcggagcgcaggagctgccgcctgccgggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccatta

SEQ ID NO: 444368 - DNA, 1737 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444369 - DNA, 1960 bp, Homo sapiens
  misc_feature (1607)..(1608): n is a, c, g, or t
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcacacaacaannaaccaacacaacaaaacaaaaaagaacacaacaacgggggggacacaagaaggaataccagagggggagcaaaagaaaccgagacaccacggaaagaagaaaagagggagccaccaacagcagaaaaaaaacaaaagagaacgaccacagaaaaaaacacgccggacaacgagacaacagagccaaaagacacaacgaaaacaaggagaggcaaaaagggggccagcagaacacgacacccaaagaacagcagaccaccgcaaaagacagggcaccacgcgaacccaaccgaaggaaggagagaaaacaagcacaaagacacgcacagaaaataaccacggcgagaagcgct

SEQ ID NO: 444370 - DNA, 2869 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggtaggcggcactgggccggggctgggggcggagacggaagcgggggtctccgggcggccgtgcgagccaggcaggtgctggggccgtcgagctggcgtggtccccctcacctggcggctctccgccgttcggggccgggagtgtcgccgagggtcggggagacgtcctggtcctacgttcctacttcccgctctcccggctgcgccccgggcctgcattttggggcgggaacccagagactgctctttctctccgggccccgggtctggcccgtccggccgggcggggagggccgggcatcccagcccgcagtcctgaggaggcgacgggcccttcttggtcaccggatctgtttacacgtcaccctcgatgcccggccgtccctccacgcccagtaacttgggctctcaggtgcctgcccggggccttggtgctggagtgggggctgtgggggcagcacaggtactctgattttggggccacgagggccaaatccgcgcctgcacgtaggaggtgcgcagtggacacgtgcgaggtggacgagggaaggaccctggctcctactgcattcgagcgataggtctggcaccctagcttccttcggaaccactcctgagtgaccttgggcaggccacctcgtctccccgagccttagttttccccggcggaggggggcggacagtccctgctttagaggtcattgccagggttgttgaggcaacagatgtttcgagggcggtggatgagggttgggttaaagtctcacagtgggccgggtgcggtggctcacgcctgtaatcccagtgctttgggaggctgaggcgggcggatcacgaggtcaggagatcgagatcatcttggccaacatggtgaaaccctgtctctactaaaaatgcaaaaattaactaggcgtggtggtgcgcgcctgtagtcccagctacttgggaggctgaagcaagagaaccgcttgaacgggggtggatgttgcagtgagccaagatggtgccactgcactccagcctggcaacagtgcgcagagcgagacgccgtctcaaaacaaaagtctcacagtggcccagcctcctttcctgccatccctggagttgtggtctgtttgaggtttggttttcaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444371 - DNA, 1850 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccagcctggcaacagtgcgcagagcgagacgccgtctcaaaacaaaagtctcacagtggcccagcctcctttcctgccatccctggagttgtggtctgtttgaggtttggttttcaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444372 - DNA, 1632 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcaggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444373 - DNA, 1486 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttggttcccttcctccgggaaagtccacgagggtggcctatgggggccgcattctcgcgaaatttcctgtgtccacgtggtcatacttacaccccagttaaaacatttcacgcccttgttcctgtgtgacgggtttccgcaccacccacggttcccgta

SEQ ID NO: 444374 - DNA, 1755 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagtgcatcccccaccccaagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444375 - DNA, 1669 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatgggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444376 - DNA, 1939 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgccgtgagcatagtcttgggcctttgacctccctctgtccccacctcggcccaaacccagtcagtcccagctcccagccccaacctctgccagcctagggataggggggtgttctaggtccccagacctgggacagcaggtaggtgatgccatgtaagacctgtgatctcacttctccccattgtcacccccaatccccacacagtgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444377 - DNA, 2265 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgccgtgagcatagtcttgggcctttgacctccctctgtccccacctcggcccaaacccagtcagtcccagctcccagccccaacctctgccagcctagggataggggggtgttctaggtccccagacctgggacagcaggtaggtgatgccatgtaagacctgtgatctcacttctccccattgtcacccccaatccccacacagtgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcaggtaggcacccaagctgcagggggtgggtgagggaaccctggggtgatgcacaaagggtctacagccaagtcccagctttgtgactagtgaccatgaagttacttagcttttctgagccatgggtttctcatctgtgaagtgggcctagcaggtagagtatttgcccaggcggtcaggagattaattcctacagagtgcctgcttctgagcctgcatgtagcagacaagactcacagctgggagggagtggtggcagtgaaaggtggacggtctggggccacttccttgcccttcccgtctctaatcagtgcatcccccaccccaagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444378 - DNA, 1699 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgccgtgagcatagtcttgggcctttgacctccctctgtccccacctcggcccaaacccagtcagtcccagctcccagccccaacctctgccagcctagggataggggggtgttctaggtccccagacctgggacagcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444379 - DNA, 1497 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacagtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444380 - DNA, 1521 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaattgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacagtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444381 - DNA, 432 bp, Homo sapiens
  misc_feature (304)..(304): n is a, c, g, or t
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgatgagtcgactcttagcgtcactggtgctancattccaagataactgatgcctttcttcaggattgtggtagcactctgctagtctctaactgtaaaagtggtctcaatagggcttgaaaaagcagtttcatggatgatctttttgagacctagaaccc

SEQ ID NO: 444382 - DNA, 1867 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaaaaaaaaaaaaaaaaaaaagaagaagaaaaaagaaagaaaaccacgaaaaaaggaacacaagagaaaaacaaagaaacacaaaacataaatatgcagcagacaacgaaggccccacgaaacaaagaagacaagcaccatataagagggcgaggaccgccgggcgcccacctctacaccaccacacgcgccggaagtgccggaaagccggcacccccgagagtttgggggcaggaccctgtt

SEQ ID NO: 444383 - DNA, 1761 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaattgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444384 - DNA, 2218 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggtaggcggcactgggccggggctgggggcggagacggaagcgggggtctccgggcggccgtgcgagccaggcaggtgctggggccgtcgagctggcgtggtccccctcacctggcggctctccgccgttcggggccgggagtgtcgccgagggtcggggagacgtcctggtcctacgttcctacttcccgctctcccggctgcgccccgggcctgcattttggggcgggaacccagagactgctctttctctccgggccccgggtctggcccgtccggccgggcggggagggccgggcatcccagcccgcagtcctgaggaggcgacgggcccttcttggtcaccggatctgtttacacgtcaccctcgatgcccggccgtccctccacgcccagtaacttgggctctcaggaggtgcgcagtggacacgtgcgaggtggacgagggaaggaccctggctcctactgcattcgagcgataggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444385 - DNA, 1434 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcacgtcctgatgaacttggtccacggggttccactggccatgctggctagaaaggatc

SEQ ID NO: 444386 - DNA, 1804 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaaaaaaaaaaaaaaaaaaaagaagaagaaaaaagaaagaaaaccacgaaaaaaggaacacaagagaaaaacaaagaaacacaaaacataaatatgcagcagacaacgaaggccccacgaaacaaagaagacaagcaccatataagagggcgaggaccgccgggcgcccacctctacaccaccacacgcgccggaagtgccggaaagccggcacccccgagagtttgggggcaggaccctgtt

SEQ ID NO: 444387 - DNA, 2063 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcaggtaggcacccaagctgcagggggtgggtgagggaaccctggggtgatgcacaaagggtctacagccaagtcccagctttgtgactagtgaccatgaagttacttagcttttctgagccatgggtttctcatctgtgaagtgggcctagcaggtagagtatttgcccaggcggtcaggagattaattcctacagagtgcctgcttctgagcctgcatgtagcagacaagactcacagctgggagggagtggtggcagtgaaaggtggacggtctggggccacttccttgcccttcccgtctctaatcagtgcatcccccaccccaagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444388 - DNA, 1707 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgtgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444389 - DNA, 1521 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcatgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444390 - DNA, 1687 bp, Homo sapiens
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatgggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagtgcatcccccaccccaagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaaaaaaaaaaaaaaaaccggggggtttatgggcgggggggaaagggatgaagggctggcaaagggtccgagcccattttggtaccaggggaacgggggccccaaaggggggaaaccgaaacgggacg

SEQ ID NO: 444391 - DNA, 1104 bp, Homo sapiens
  misc_feature (803)..(803): n is a, c, g, or t
  misc_feature (808)..(809): n is a, c, g, or t
ggaatataggcaataaggtagagacctggtgattaatcggacagaggactaaggtgcgctgcgagcgcgcgcggaccgcgcacaggcggcggagccggtatgggcccgcctggccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagcctgtactgttcnactannagctgttgcagaccgtggctcaaggggctcaggccgatgagccgactcctggtgggccaattaactttggaggcgcgctggggccactccgggaccacggcctgcgagggatgcacctaacccctgttgaggcgtgtaacaccacgcgagatgttactactagccacgtaggagcgttagagaacccccagtagtgtgcacagccgacggtcagcgccagagtactagcgcaatcacaagaacgcttggtggcacctcacaatagtgcgcaccgtccaaactagacatctgtaca

SEQ ID NO: 444392 - DNA, 1054 bp, Homo sapiens
gctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaata

SEQ ID NO: 444393 - DNA, 641 bp, Homo sapiens
  misc_feature (591)..(592): n is a, c, g, or t
  misc_feature (641)..(641): n is a, c, g, or t
aactgataaaagaggaatatctacaatccccaaaaccacataaactacattaaattgattggctactatcatgtacagatgcctacactaatattagggtagtcctcggtgctgcttctttctattagacctaaaaacattaaatatttatgcaattaaaatctatatatttctattttttaactcaaaagtttcttttactggagaaataataagaatgttttaatgttctaagtaggaattgccattcttgctataagaaagcaagattatatattaaggatgacattattcttttgagtgtaattgctgcatcagatgatacacatgttgagcatctttctgtgtaactgactaagccttgcagtgcatgtagtattcttgtctcctgatacaaacattttcagacgttctgtttgcttttttttcctcaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattagacannattcggcctatagtagagtcgtattacatttcaactgcccgccggttan

SEQ ID NO: 444394 - DNA, 1786 bp, Homo sapiens
gctagctctgggcgcagaggtttctgggagccaagagtggtaatggcgtctgtatgatcttcggagcctgctgcatcggacctcggccagtgtgagcggcaagaggataggagattatctttcttatcgcgatgggacgggaaagggcagttggggtcggagtcggcggcagagtgcagagcgcgggcggtggaggccctggagcagcgggctaggggcggaaccgagtgcctgtcaggcgcgtctggagctcttgggcccgccgaggagatcgcagcgtacaggcagctcgcctactgcgtaaagcgaaccccagcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444395 - DNA, 1754 bp, Homo sapiens
gctagctctgggcgcagaggtttctgggagccaagagtggtaatggcgtctgtatgatcttcggagcctgctgcatcggacctcggccagtgtgagcggcaagaggataggagattatctttcttatcgcgatgggacgggaaagggcagttggggtcggagtcggcggcagagtgcagagcgcgggcggtggaggccctggagcagcgggctaggggcggaaccgagtgcctgtcaggcgcgtctggagctcttgggcccgccgaggagatcgcagcgtacagcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444396 - DNA, 1870 bp, Homo sapiens
gctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgaggtaccaacactatccaagacatttgtctcataaaattatgttgttgatagtttttctttatgtagcaattggaaaatgttaaccatttgtttacttttacagattgatgtgagctgtactactttcttaggtcattagagataataacaacaaatatttaccaaaggcttatttgcccaggcactgtggatgtgagttcactgtggataatgcttttaatgtgggctccttgtgctcacaggtccctaaaacattttaagaaatgaagtatttgttttactaagttaaatgatttttgtttccccccagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444397 - DNA, 1503 bp, Homo sapiens
gctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444398 - DNA, 1420 bp, Homo sapiens
gctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgtatgttttgtttcctcctttcatctctaataattgatttaccatgtttttctaaaatacttgttatgtctttgctttaagaagtgacatatatttatgtttagttactgttattcaaatatagccctgacctcagtgctaaactttatagttgattttaaaatcaaaagtattattttgtgggactttaagaacaagtttgatctctagagaaccaaatatggaaggaatctataaaaggatatgctttcccccaaaataatgtcctgtactaaactactgcactactgctgtgttacacacctctccagggcactcttcatactgggcttcctataaacagtgccctctagagttgtacctggaggcctttccatattagatatgtccccttctataagtgcaatacacttaatggttccctctgtgcttagggagggaagtaatctaagcagaaggtttttaaggattagcacatcagttaatgttaaaattctgtgggaccctagagcctataatcaatttgcagttttctacatacaggacagtgaaaaacctgagtggcatccaatgagtgatatctaactatgtatacatatcagcagttaattctagagttaattgatggagttactcataatagttaaaacaggaaacctaatttcaactgaaatttaatgattattcatttgaaattattttcttctgagaatttagcacacttttttgcacttttgagtatctttgctgctagcttaaagttgttttgagctacataaaattgttttgactttcttagggtgatacgttgtacatatgtactgtgttttggtagtgtgtattttccctccaatcttctgggctctcactgttcttttaggaggaagatgaagattttgaagaagaaagtgatgatgatgatactgcagctcttgtcacaataagcgcattgttctaatggtgtgtagataatcggagtagatagaga

SEQ ID NO: 444399 - DNA, 1336 bp, Homo sapiens
aactgataaaagaggaatatctacaatccccaaaaccacataaactacattaaattgattggctactatcatgtacagatgcctacactaatattagggtagtcctcggtgctgcttctttctattagacctaaaaacattaaatatttatgcaattaaaatctatatatttctattttttaactcaaaagtttcttttactggagaaataataagaatgttttaatgttctaagtaggaattgccattcttgctataagaaagcaagattatatattaaggatgacattattcttttgagtgtaattgctgcatcagatgatacacatgttgagcatctttctgtgtaactgactaagccttgcagtgcatgtagtattcttgtctcctgatacaaacattttcagacgttctgtttgcttttttttcctcaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444400 - DNA, 523 bp, Homo sapiens
agctctgggcgcagaggtttctgggagccaagagtggtaatggcgtctgtatgatcttcggagcctgctgcatcggacctcggccagtgtgagcggcaagaggataggagattatctttcttatcgcgatgggacgggaaagggcagttggggtcggagtcggcggcagagtgcagagcgcgggcggtggaggccctggagcagcgggctaggggcggaaccgagtgcctgtcaggcgcgtctggagctcttgggcccgccgaggagatcgcagcgtacaggcagctcgcctactgcgtaaagcgaaccccaggtcctcccttcactacccttcgcacccctgcagtgctgggcacgggtgaagaggcagcgagtttctggttatagccaaagactagctcacgggaggccggagtgataattccgtgggtgtgtgggaaggggcggcgcccccagcgccagataaccctgttttcttctttgtatacatgtctctaccctttttgaaagttgagagaattag

SEQ ID NO: 444401 - DNA, 1561 bp, Homo sapiens
gctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444402 - DNA, 2441 bp, Homo sapiens
gctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgtatgttttgtttcctcctttcatctctaataattgatttaccatgtttttctaaaatacttgttatgtctttgctttaagaagtgacatatatttatgtttagttactgttattcaaatatagccctgacctcagtgctaaactttatagttgattttaaaatcaaaagtattattttgtgggactttaagaacaagtttgatctctagagaaccaaatatggaaggaatctataaaaggatatgctttcccccaaaataatgtcctgtactaaactactgcactactgctgtgttacacacctctccagggcactcttcatactgggcttcctataaacagtgccctctagagttgtacctggaggcctttccatattagatatgtccccttctataagtgcaatacacttaatggttccctctgtgcttagggagggaagtaatctaagcagaaggtttttaaggattagcacatcagttaatgttaaaattctgtgggaccctagagcctataatcaatttgcagttttctacatacaggacagtgaaaaacctgagtggcatccaatgagtgatatctaactatgtatacatatcagcagttaattctagagttaattgatggagttactcataatagttaaaacaggaaacctaatttcaactgaaatttaatgattattcatttgaaattattttcttctgagaatttagcacacttttttgcacttttgagtatctttgctgctagcttaaagttgttttgagctacataaaattgttttgactttcttagggtgatacgttgtacatatgtactgtgttttggtagtgtgtattttccctccaatcttctgggctctcactgttcttttaggaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444403 - DNA, 1447 bp, Homo sapiens
gctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444404 - DNA, 1379 bp, Homo sapiens
gctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataacagttttg

SEQ ID NO: 444405 - DNA, 851 bp, Homo sapiens
  misc_feature (235)..(235): n is a, c, g, or t
  misc_feature (348)..(348): n is a, c, g, or t
  misc_feature (844)..(849): n is a, c, g, or t
  misc_feature (851)..(851): n is a, c, g, or t
cctgcacacccggaagcagatcgcgctggggaaaggccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagtagtctgcccacctcggcctcccaaagtgctgggattncaggtgtgagccaccgctcccagcctctctgtacaaattttttgccacacaaatctgaaaataccaccttgatttatggatcctccaagtttttcactgaagtacaagggaanaaatgtaaatctataaattgggttaaatgatttctaggaaagtgtataataataataacaattatttttttgagacagagtctctgtcacccaggctggagtgaaactgtgtctcaaaataaataaataaataataaataaataaataatagaaatgaagttttgctatagttgagaaattatagaatgccatgcttattatgataacctcatacagaaatttttacagctttttgaaaaatggcttttttgttattcaatttttatagtcttataaacattaattttcacaagactagtgtaaaaatattgtagacaatttgtctaagcagtatttcggaagcactttcaacagttatgtaaagggtcctatttatgcttgaagaaaggacatgtataaggtttttagcatgaggaaattaagtctttctcaacctagaagtcaggagtttcaagagtaaacattcagtgttgaattaaagaatctgaatctaannnnnnan

SEQ ID NO: 444406 - DNA, 316 bp, Homo sapiens
cctgcacacccggaagcagatcgcgctggggaaaggccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagtaggtaggagaattgcttccctttcggtttaaaatctctctgaggccgttccttgctctctgcctttcttccttaggaccatgtagacaaccccattcaggtagtgttcccgcttaaaa

SEQ ID NO: 444407 - DNA, 1028 bp, Homo sapiens
  misc_feature (412)..(412): n is a, c, g, or t
  misc_feature (525)..(525): n is a, c, g, or t
  misc_feature (1021)..(1026): n is a, c, g, or t
  misc_feature (1028)..(1028): n is a, c, g, or t
cccgccacgaagcccagctaatttttgtatttttggcagaaacagggtttcaccatgttggccaggctgctcttgaactcctgacctcaagtgatccgcccacctcagcctcccaaagtgcagatatgctttacaaatgaaatgagggtggcagaagcttcaccagagttcagtcactacttgagagtttatattggaaagaaatcgtataaatgtatgtgctagaggcttccccgaggtgtctgaactcactagacctcagaatatacatctttgacaaatgtaatgtgtgtgctaagactttttacccgaacatccaaatggaaacatcagagtattcatactggagaacagtcttacaaatgtaacgaatgtggtaagcctttttaaaaatcaaatggtgctgggattncaggtgtgagccaccgctcccagcctctctgtacaaattttttgccacacaaatctgaaaataccaccttgatttatggatcctccaagtttttcactgaagtacaagggaanaaatgtaaatctataaattgggttaaatgatttctaggaaagtgtataataataataacaattatttttttgagacagagtctctgtcacccaggctggagtgaaactgtgtctcaaaataaataaataaataataaataaataaataatagaaatgaagttttgctatagttgagaaattatagaatgccatgcttattatgataacctcatacagaaatttttacagctttttgaaaaatggcttttttgttattcaatttttatagtcttataaacattaattttcacaagactagtgtaaaaatattgtagacaatttgtctaagcagtatttcggaagcactttcaacagttatgtaaagggtcctatttatgcttgaagaaaggacatgtataaggtttttagcatgaggaaattaagtctttctcaacctagaagtcaggagtttcaagagtaaacattcagtgttgaattaaagaatctgaatctaannnnnnan

SEQ ID NO: 444408 - DNA, 1079 bp, Homo sapiens
  misc_feature (463)..(463): n is a, c, g, or t
  misc_feature (576)..(576): n is a, c, g, or t
  misc_feature (1072)..(1077): n is a, c, g, or t
  misc_feature (1079)..(1079): n is a, c, g, or t
tgctgggattacaggcgtgagccactgcgcccggccagaatatagctaagttttaagcaagtgttcactaggcataagaatatacatcctggagagaaatcacagaagtgtagtatatgtggcaagaatactacttaaaggtcaaaacttgtggatctataactcaaagtgcagatatgctttacaaatgaaatgagggtggcagaagcttcaccagagttcagtcactacttgagagtttatattggaaagaaatcgtataaatgtatgtgctagaggcttccccgaggtgtctgaactcactagacctcagaatatacatctttgacaaatgtaatgtgtgtgctaagactttttacccgaacatccaaatggaaacatcagagtattcatactggagaacagtcttacaaatgtaacgaatgtggtaagcctttttaaaaatcaaatggtgctgggattncaggtgtgagccaccgctcccagcctctctgtacaaattttttgccacacaaatctgaaaataccaccttgatttatggatcctccaagtttttcactgaagtacaagggaanaaatgtaaatctataaattgggttaaatgatttctaggaaagtgtataataataataacaattatttttttgagacagagtctctgtcacccaggctggagtgaaactgtgtctcaaaataaataaataaataataaataaataaataatagaaatgaagttttgctatagttgagaaattatagaatgccatgcttattatgataacctcatacagaaatttttacagctttttgaaaaatggcttttttgttattcaatttttatagtcttataaacattaattttcacaagactagtgtaaaaatattgtagacaatttgtctaagcagtatttcggaagcactttcaacagttatgtaaagggtcctatttatgcttgaagaaaggacatgtataaggtttttagcatgaggaaattaagtctttctcaacctagaagtcaggagtttcaagagtaaacattcagtgttgaattaaagaatctgaatctaannnnnnan

SEQ ID NO: 444409 - DNA, 680 bp, Homo sapiens
cccgccacgaagcccagctaatttttgtatttttggcagaaacagggtttcaccatgttggccaggctgctcttgaactcctgacctcaagtgatccgcccacctcagcctcccaaagtgcagatatgctttacaaatgaaatgagggtggcagaagcttcaccagagttcagtcactacttgagagtttatattggaaagaaatcgtataaatgtatgtgctagaggcttccccgaggtgtctgaactcactagacctcagaatatacatctttgacaaatgtaatgtgtgtgctaagactttttacccgaacatccaaatggaaacatcagagtattcatactggagaacagtcttacaaatgtaacgaatgtggtaagcctttttaaaaatcaaatgggctgggtatggtggctcacacctgtaatcccagcactttgggaggccgaggtgggtggatcatctgatgtcaggagtttgagaccggcctggccagcatggtgaaaccccatctctactaaaaaatacaaaaattagctgggcagtggtgggcacctgtaatcccgctacttgggaggctgaggcagaagaatcacttgaatccaggatgtggaggttgctgtaagccgagattgcgccattgtactccagcctgggtgacaagagtgagactctgtct

SEQ ID NO: 444410 - DNA, 1010 bp, Homo sapiens
  misc_feature (951)..(951): n is a, c, g, or t
  misc_feature (983)..(983): n is a, c, g, or t
  misc_feature (987)..(987): n is a, c, g, or t
  misc_feature (991)..(991): n is a, c, g, or t
attttgttttcctctttttatttgtctgctaagaaggctagaagcaaattgagttgcctgttcgttccttcatatatgtctcctcctctgccaacaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgtttcatttcctgtggagtatacagcatggtccggattatcatcactcggtccagaaggtcaagagggatgccgtgaggggatgtgatgtcctcagtgcctctgatgacacagttgcctcggttggatgcaaagatgacgatgggagcgatagaagactccagggcgcggtgcaggtaggtgaagcactcaatgtccagcatgtggacctcatcaacaaacagcacacccgggaccagctcagcaatgccctggtcgatgtacttgttcaccaccttattaatctcccctcgaagtttgtctgtgatttctgtcttctttggcttcattagctggcccatcatggacaggatatcttgtcccccctggggccgcgcattagccacatccaagtcatgcaaggtcacatcttggatgatttctttctttttgtgcacatccccttttggcaaggggacatactcttcagcttcaaggtcgaattctgtggcataggtatcacacctgcnctgcctcttcacggccccactgttggcttcantgtnaatnacatctccagcttctactc

SEQ ID NO: 444411 - DNA, 3636 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444412 - DNA, 406 bp, Homo sapiens
agcagaggggcctttgaggcattaggtcccaaagtctcaggtgagcctgttggccgcctggctcacggggagctctgtgggtgtccaggagctgactgtgtcccctcccccaggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcagttaggtaaggaagggcaaagtccaggtgaccttagatgctgccacagcactcttcagtctgcacagtcctcagtacaactactcatctcttccatcgccactgcactccagcctgggcaacagaccaagatccgtctcaaaa

SEQ ID NO: 444413 - DNA, 3525 bp, Homo sapiens
gaggtgatcggcggtgcagatctagaggaccctgagttgaagcagggacccggaggcccgagcagccgccgccatgggaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444414 - DNA, 2741 bp, Homo sapiens
ctgtgtttctgtgcagcaggctgaaatgaggcagtgaaggggatttggttctgtttggcttctcagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444415 - DNA, 3675 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtaaaaacaacaacaaaaaaccggggataagggggggggaag

SEQ ID NO: 444416 - DNA, 2431 bp, Homo sapiens
aagcaaaaatgatcatagtcggtgccggttgtgattccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444417 - DNA, 2321 bp, Homo sapiens
agcagaggggcctttgaggcattaggtcccaaagtctcaggtgagcctgttggccgcctggctcacggggagctctgtgggtgtccaggagctgactgtgtcccctcccccaggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444418 - DNA, 3360 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444419 - DNA, 1825 bp, Homo sapiens
tacgaggacgtcggaagggaaaaaaaaattggtaggacgaggctggggttgaatcggccgaggccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444420 - DNA, 3111 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444421 - DNA, 1508 bp, Homo sapiens
cccacgcgtccgcggacgcgtgggcttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444422 - DNA, 1389 bp, Homo sapiens
cgtccttcatcatacctgcccatgccagagttctgggcccagaactgctccaggaagcccttattcatgggccattcccacgcatcagattggcatgcaaagaatccccgctgacattttataagcaggttcctgaattacgagtttgaaattttttttttttttttggctaggtatgatgaaggaccgtccttcatcatacctacaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444423 - DNA, 2349 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggccaggctcagcttggcagagctgatgacccatgtgaactaaacacggagctagcagaaacaggcagactctaagcccaaccagaagag

SEQ ID NO: 444424 - DNA, 1779 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgccaggctgtggtgagagtttgggccagaggtgatggtgccagatacagctgtacccttggagatggagcagttaggtaaggaagggcaaagtccaggtgaccttagatgctgccacagcactcttcagtctgcacagtcctcagtacaactactcatctcttccatcgtcactcagaagcagccacagacagacaacagacaaatgagcatggccgtgttcctacaaagctggctacaaagtcagctgcagaccaggttgtcctatgggccttacctaaaggaagcaaccacaggaaaagccagaattgcaaacttcagatcattttctaatccctagcagggatggtaggcaatttagttcattctcttaatattaagctgctggatttacagcactgtgcagtagaagtagaattcaagtcacatgtagtttttaaaatttctagaagtcacattaaaaaagtaaaaagaaacaggtgaaattaaatttaatatatttaacctagtatatccaaagtatcatttcaacattataattaatgttaagatgacatctcagtttggtctagtcacagtcccctggccacgtgtggccagtgtggccactgcctggacagcagcgccttggcct

SEQ ID NO: 444425 - DNA, 1558 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgccattaacgaaacaaaattaaggcagttctaacgtaagtgaaatcatgttcttctgggttgggcctatcgacaggtaagatacatttttaagttcttagttcaagagaagcaaaaagtactctagctctgaaacctcattgctctcttatagaaagtttgtatgatatttataggtaacttctgcatctcggaaacggcctatcttcttaagctgtcttacctttaaaagtattccatctcttaaacttgcttctgagtaagagacctgaactgctattgttttcctgtaattggattgatctttgtattttttgatggtccactttgtattttggtgtttatttaaaagaagggacagagatgaaaggcagtttgatgtttgtgaaaggtatttatacgagctacatgct

SEQ ID NO: 444426 - DNA, 1713 bp, Homo sapiens
  misc_feature (1654)..(1654): n is a, c, g, or t
  misc_feature (1686)..(1686): n is a, c, g, or t
  misc_feature (1690)..(1690): n is a, c, g, or t
  misc_feature (1694)..(1694): n is a, c, g, or t
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgtttcatttcctgtggagtatacagcatggtccggattatcatcactcggtccagaaggtcaagagggatgccgtgaggggatgtgatgtcctcagtgcctctgatgacacagttgcctcggttggatgcaaagatgacgatgggagcgatagaagactccagggcgcggtgcaggtaggtgaagcactcaatgtccagcatgtggacctcatcaacaaacagcacacccgggaccagctcagcaatgccctggtcgatgtacttgttcaccaccttattaatctcccctcgaagtttgtctgtgatttctgtcttctttggcttcattagctggcccatcatggacaggatatcttgtcccccctggggccgcgcattagccacatccaagtcatgcaaggtcacatcttggatgatttctttctttttgtgcacatccccttttggcaaggggacatactcttcagcttcaaggtcgaattctgtggcataggtatcacacctgcnctgcctcttcacggccccactgttggcttcantgtnaatnacatctccagcttctactc

SEQ ID NO: 444427 - DNA, 763 bp, Homo sapiens
tggctgggcacggaaggggttgatgtgcatctgaagcagggcagaagggatggagcctgcagtctcttaggaaggtcagtgctaatacatgaaaccacgctagagagggagagggggaggccacatacctgccaggctgtggtgagagtttgggccagaggtgatggtgccagatacagctgtacccttggagatggagcagttaggtaaggaagggcaaagtccaggtgaccttagatgctgccacagcactcttcagtctgcacagtcctcagtacaactactcatctcttccatcgtcactcagaagcagccacagacagacaacagacaaatgagcatggccgtgttcctacaaagctggctacaaagtcagctgcagaccaggttgtcctatgggccttacctaaaggaagcaaccacaggaaaagccagaattgcaaacttcagatcattttctaatccctagcagggatggtaggcaatttagttcattctcttaatattaagctgctggatttacagcactgtgcagtagaagtagaattcaagtcacatgtagtttttaaaatttctagaagtcacattaaaaaagtaaaaagaaacaggtgaaattaaatttaatatatttaacctagtatatccaaagtatcatttcaacattataattaatgttaagatgacatctcagtttggtctagtcacagtcccctggccacgtgtggccagtgtggccactgcctggacagcagcgccttggcct

SEQ ID NO: 444428 - DNA, 399 bp, Homo sapiens
cctgtgcattcttctccaaaacgtggattgaggtctcaggttcctctgccaaagatgtaagtagaagcaaaactttctggaagggtgatgaaagtgtgactggtataaggggtgtggacttgtcacctcatcataaataatggtctgtgacgtgtgcagatagatcgtcgtcctttagggggcagttcagaagctttaagggctgacagatggagtccagcagtagatcagctgtgggtatgagaatctgaatccacactgtaaagttagactttttcatatgacttccttgcggcagttttaaagttctctgtatgaatattgtcagtgctcgaagaggcgatctgtaactgttcagtaccacttggaatgcctatttccccttcagcctccaattcc

SEQ ID NO: 444429 - DNA, 446 bp, Homo sapiens
gtgctgtggaccgctatcaccctctttatcttcttagtgtgctgccaggtaagctcaggcttgtatttcgtattggggagggggataagagtggctggaaacaggagtgctgactgttttgctctttgcctgttcccagattcccctgtttgggatcatgtcttcagattcagctgaccctttctattggatgagagtgattctagcctctaacagaggtaggactctggctctgtcttttctctgtagagtgtaggcttacctagcttcacttagttaaattaataggctttggctttatatggaacttagagagtgacttggaaaatagagtgaagaatgttaaagtgctgtgttgaatagccttattaaatgctgagttcagcaccaaggcataccatcatatttggaattgtatttgaatgcagtacaaaacctgtaatgag

SEQ ID NO: 444430 - DNA, 600 bp, Homo sapiens
gtcacggtgggtgggtgggggctgaccccagcttccaggggactgtcactgtggacgccaaaatggcataactgagataaggtgaataagtgacaaataaagccagttttttacaaggtacttgatcatgttctcttgattttaaattagattttattcccaaaaaggccagtgaggcgcaaagcttggttgcagctttgtgtgtgtcaaaggcttggttggggcactcaggcattttgcctggaaaagttcccttctgatggtcatgtcaacctggtgctcacatttgtgataaagtgatatgggtgctgggccacatgtggagctgctgcagggctctgcccgtgaggcagagtgcactggctgtcccgtgagaatgcagaggcctccgctgagccagggcgcctgccaccccgtggaagagtgggaaccttctagcaggagcctagggccccataactcgaagccctttgagcctcagctccagtacccagctggtgattggagaagtcttaacttggttgtgaggctggcctcagacccgacctgtagccaagccagaaggacccagtgttgtgtgggtgggagtggcaggcttgt

SEQ ID NO: 444431 - DNA, 546 bp, Homo sapiens
caggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaag

SEQ ID NO: 444432 - DNA, 907 bp, Homo sapiens
  misc_feature (848)..(848): n is a, c, g, or t
  misc_feature (880)..(880): n is a, c, g, or t
  misc_feature (884)..(884): n is a, c, g, or t
  misc_feature (888)..(888): n is a, c, g, or t
attttgttttcctctttttatttgtctgctaagaaggctagaagcaaattgagttgcctgttcgttccttcatatatgtctcctcctctgccaacaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgatgacacagttgcctcggttggatgcaaagatgacgatgggagcgatagaagactccagggcgcggtgcaggtaggtgaagcactcaatgtccagcatgtggacctcatcaacaaacagcacacccgggaccagctcagcaatgccctggtcgatgtacttgttcaccaccttattaatctcccctcgaagtttgtctgtgatttctgtcttctttggcttcattagctggcccatcatggacaggatatcttgtcccccctggggccgcgcattagccacatccaagtcatgcaaggtcacatcttggatgatttctttctttttgtgcacatccccttttggcaaggggacatactcttcagcttcaaggtcgaattctgtggcataggtatcacacctgcnctgcctcttcacggccccactgttggcttcantgtnaatnacatctccagcttctactc

SEQ ID NO: 444433 - DNA, 3641 bp, Homo sapiens
ccaaggggttggtacgctccggagtacgggatcgcccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444434 - DNA, 3037 bp, Homo sapiens
cggaccggacttctggtgtgttggaatttgctgctaatcaccatcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444435 - DNA, 2917 bp, Homo sapiens
ccaaggggttggtacgctccggagtacgggatcgcccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctcttccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444436 - DNA, 3634 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccggttttcgcgcagcgcctctggcattccctgaccggcagtctgtttatatggttaataagtggctgatctgttcagtattaaacaaggt

SEQ ID NO: 444437 - DNA, 2331 bp, Homo sapiens
ccaaggggttggtacgctccggagtacgggatcgcccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaagccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444438 - DNA, 1850 bp, Homo sapiens
cccggtgtagcccaactgtgagcacaacagaacttattccagacataaacatgagtcttcttatttcaaacactggagcaactgatcaacaccaccacagcccatgcaccccgaacctgacttcactaccaaccttgagcctgtgctgtcctctctctgctgacgacactggtgacgcagaaaggaagtcggtggtgtctgctcacttgcgtgcagtcctaagcacagtaagaaaattctgaacacagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 444439 - DNA, 2123 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagcttccaggggactgtcactgtggacgccaaaatggcataactgagataaggtgaataagtgacaaataaagccagttttttacaaggta

SEQ ID NO: 444440 - DNA, 2083 bp, Homo sapiens
  misc_feature (1481)..(1481): n is a, c, g, or t
  misc_feature (2024)..(2024): n is a, c, g, or t
  misc_feature (2056)..(2056): n is a, c, g, or t
  misc_feature (2060)..(2060): n is a, c, g, or t
  misc_feature (2064)..(2064): n is a, c, g, or t
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgccaggctgtggtgagagtttgggccagaggtgatggtgccagatacagctgtacccttggagatggagcagttaggtaaggaagggcaaagtccaggtgaccttagatgctgccacagcactcttcagtctgcacagtcctcagtacaactactcatctcttccatcgtcactcagaagcagccacagacagacaacagacaaatgagcatggccgtgttcctacaaagctggctacaaagtcagctgcagaccaggttgtcctatgggccttacctcagtgtggtcttggtgccaatctcccccaggtggttcagtgcctcctcactgatgtngattccttccgtctgggcacggattttaatgatctgtttcatttcctgtggagtatacagcatggtccggattatcatcactcggtccagaaggtcaagagggatgccgtgaggggatgtgatgtcctcagtgcctctgatgacacagttgcctcggttggatgcaaagatgacgatgggagcgatagaagactccagggcgcggtgcaggtaggtgaagcactcaatgtccagcatgtggacctcatcaacaaacagcacacccgggaccagctcagcaatgccctggtcgatgtacttgttcaccaccttattaatctcccctcgaagtttgtctgtgatttctgtcttctttggcttcattagctggcccatcatggacaggatatcttgtcccccctggggccgcgcattagccacatccaagtcatgcaaggtcacatcttggatgatttctttctttttgtgcacatccccttttggcaaggggacatactcttcagcttcaaggtcgaattctgtggcataggtatcacacctgcnctgcctcttcacggccccactgttggcttcantgtnaatnacatctccagcttctactc

SEQ ID NO: 444441 - DNA, 1725 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgccaggctgtggtgagagtttgggccagaggtgatggtgccagatacagctgtacccttggagatggagcagttaggtaaggaagggcaaagtccaggtgaccttagatgctgccacagcactcttcagtctgcacagtcctcagtacaactactcatctcttccatcgtcactcagaagcagccacagacagacaacagacaaatgagcatggccgtgttcctacaaagctggctacaaagtcagctgcagaccaggttgtcctatgggccttacctaaaggaagcaaccacaggagcaatttagttcattctcttaatattaagctgctggatttacagcactgtgcagtagaagtagaattcaagtcacatgtagtttttaaaatttctagaagtcacattaaaaaagtaaaaagaaacaggtgaaattaaatttaatatatttaacctagtatatccaaagtatcatttcaacattataattaatgttaagatgacatctcagtttggtctagtcacagtcccctggccacgtgtggccagtgtggccactgcctggacagcagcgccttggcct

SEQ ID NO: 444442 - DNA, 3650 bp, Homo sapiens
cagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacagatagcagcgggaaagagtggtgggtgaccaacaatacctactggaggctgcgggccgagccaggctacgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagcccggccttccccctgctgggggtccaccacatcgctgctctttctcacagtctgcctctgatgagggcgaattgctatgacattccaagctccaataaagactgtcccaga

SEQ ID NO: 444443 - DNA, 2983 bp, Homo sapiens
tgccccttttccccaccctgtgagtaaaattgcccccaccttgacttgccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtgaggcctgggggacagggtgactggtgcggggagagggcttcaagctgaggactgccagcctggggtccgatagcagatctgggtcagggtggggggttggcagaggcagtctctgcagagatgcggcaaggtggggaggacctcatcctcctggcaccgtgtccctcaccctctccctgcaggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacagatagcagcgggaaagagtggtgggtgaccaacaatacctactggaggctgcgggccgagccaggctacgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagcccggccttccccctgctgggggtccaccacatcgctgctctttctcacagtctgcctctgatgagggcgaattgctatgacattccaagctccaataaagactgtcccaga

SEQ ID NO: 444444 - DNA, 3979 bp, Homo sapiens
cagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacgtgagcccgggcagtggcttggggttgtgggaggagtctggccccagtatgccctgggcaggcatggggtatctggaatcgaccagagcagggtctgaatcccaggtccaccacttgctgaatgtgtgatctcgggcaagttacatccctgggccatagcttcctcacctctaatgggagagcaccatcccccaggtgcagagctgtcatggtaagggaggtcatacgtacaaggctctctggacagggcagaataagtgcccaagaaatgggggctttaccaccctcatcctggtcccattctcaggctgggaacaaggaactgaaggcctgggtacccaggatctctctgggagggtgttgccttccacaaccctgcagacccctgagggtgggaatagtttttcttgatctgtgacttcttagagaccaagatgtgacttgacgtaggggagcgttctgcacatgggaggatgattgacaagtctctactgatagtgtgacttggacatgagggtgaacctgccacctggcccttgagcctagaatggcatcagggagatggtggctctatggctctgagagcctaaaacaggtcccctctccctctaccaacacttcacccccagatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtgaggcctgggggacagggtgactggtgcggggagagggcttcaagctgaggactgccagcctggggtccgatagcagatctgggtcagggtggggggttggcagaggcagtctctgcagagatgcggcaaggtggggaggacctcatcctcctggcaccgtgtccctcaccctctccctgcaggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacagatagcagcgggaaagagtggtgggtgaccaacaatacctactggaggctgcgggccgagccaggctacgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagcccggccttccccctgctgggggtccaccacatcgctgctctttctcacagtctgcctctgatgagggcgaattgctatgacattccaagctccaataaagactgtcccaga

SEQ ID NO: 444445 - DNA, 334 bp, Homo sapiens
gttggtcgtctccatggctctgttcccaacctgtctcgctacctggagtctcgggactcctcgggcacccgtgggctgccacccacagactatgcccacctgcagcgcagcttctgggccctggcccagaagggtaagtgcctgctgggaggggctggtggggagcggacaggagcgagcgaggactctgatggtctgccccactccctgtagtgcacagctccctcagcagcgtcctggccgccctcaccatggaacgggaccaactgagggacatgcaccagggctcagagttgtcaagaatgggggtgaggcctgggggacagggtgactg

SEQ ID NO: 444446 - DNA, 4464 bp, Homo sapiens
cagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacgtgagcccgggcagtggcttggggttgtgggaggagtctggccccagtatgccctgggcaggcatggggtatctggaatcgaccagagcagggtctgaatcccaggtccaccacttgctgaatgtgtgatctcgggcaagttacatccctgggccatagcttcctcacctctaatgggagagcaccatcccccaggtgcagagctgtcatggtaagggaggtcatacgtacaaggctctctggacagggcagaataagtgcccaagaaatgggggctttaccaccctcatcctggtcccattctcaggctgggaacaaggaactgaaggcctgggtacccaggatctctctgggagggtgttgccttccacaaccctgcagacccctgagggtgggaatagtttttcttgatctgtgacttcttagagaccaagatgtgacttgacgtaggggagcgttctgcacatgggaggatgattgacaagtctctactgatagtgtgacttggacatgagggtgaacctgccacctggcccttgagcctagaatggcatcagggagatggtggctctatggctctgagagcctaaaacaggtcccctctccctctaccaacacttcacccccagatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtgaggcctgggggacagggtgactggtgcggggagagggcttcaagctgaggactgccagcctggggtccgatagcagatctgggtcagggtggggggttggcagaggcagtctctgcagagatgcggcaaggtggggaggacctcatcctcctggcaccgtgtccctcaccctctccctgcaggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacagatagcagcgggaaagagtggtgggtgaccaacaatacctactggaggctgcgggccgagccaggctacgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagcccggccttccccctgctgggggtccaccacatcgctgctctttctcacagtctgcctctgatgagggcgaattgctatgacattccaagctccaataaagactgtcccaga

SEQ ID NO: 444447 - DNA, 4414 bp, Homo sapiens
cagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacgtgagcccgggcagtggcttggggttgtgggaggagtctggccccagtatgccctgggcaggcatggggtatctggaatcgaccagagcagggtctgaatcccaggtccaccacttgctgaatgtgtgatctcgggcaagttacatccctgggccatagcttcctcacctctaatgggagagcaccatcccccaggtgcagagctgtcatggtaagggaggtcatacgtacaaggctctctggacagggcagaataagtgcccaagaaatgggggctttaccaccctcatcctggtcccattctcaggctgggaacaaggaactgaaggcctgggtacccaggatctctctgggagggtgttgccttccacaaccctgcagacccctgagggtgggaatagtttttcttgatctgtgacttcttagagaccaagatgtgacttgacgtaggggagcgttctgcacatgggaggatgattgacaagtctctactgatagtgtgacttggacatgagggtgaacctgccacctggcccttgagcctagaatggcatcagggagatggtggctctatggctctgagagcctaaaacaggtcccctctccctctaccaacacttcacccccagatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtgaggcctgggggacagggtgactggtgcggggagagggcttcaagctgaggactgccagcctggggtccgatagcagatctgggtcagggtggggggttggcagaggcagtctctgcagagatgcggcaaggtggggaggacctcatcctcctggcaccgtgtccctcaccctctccctgcaggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccattggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacagatagcagcgggaaagagtggtgggtgaccaacaatacctactggaggctgcgggccgagccaggctacgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagcccggccttccccctgctgggggtccaccacatcgctgctctttctcacagtctgcctctgatgagggcgaattgctatgacattccaagctccaataaagactgtcccaga

SEQ ID NO: 444448 - DNA, 1286 bp, Homo sapiens
agagatctaagccttgggtagcgagaacactcctgggaacctatttagcataagagagttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacagatagcagcgggaaagagtggtgggtgaccaacaatacctactggaggctgcgggccgagccaggctacgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagcccggccttccccctgctgggggtccaccacatcgctgctctttctcacagtctgcctctgatgagggcgaattgctatgacattccaagctccaataaagactgtcccaga

SEQ ID NO: 444449 - DNA, 675 bp, Homo sapiens
agcggagtctctcccagcgaccgccgcgggggcaaggcctggagctgtggttcgaatttgtgcaggcagcgggtgctggcttttagggtccgccgcctctctgcctaatgagctgcaccaggtaggttcgctgcaactctgcgcgctaggaacacaggggaacgcgcagctgtggggaagttggggggcgtttcagttctatcatctctggaaatggacaccccagggggaggacaagtggactgactgcgtagttgaatctggcaaccgagaggccttggaggtgtagaaatttggctctatttcttaagcagagcctattttagtaatcagcatcttaaagcagaaattatcttaacgtgaatcagcttgagttaggattttctcatggatgcggctgttcttttggtcctgcacaaatgtcccaaagactcgggcagctgaagtggtgagaacagcactctgacattgctggttaggtggtttagcttggaggaaaaaaattacaggacgacgtttgcattcattcgtccttcttatcacagtttgccatagcaaaatctcaagagtttgagcaaacgattacttttaactcttgtccaggacttaaagttccaaggaaatcacccaaactaaaactgtctttctataaatgcaaaaagtaaaaaaaaaaaa

SEQ ID NO: 444450 - DNA, 1686 bp, Homo sapiens
agcggagtctctcccagcgaccgccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaaaacaccacgaggagaaaaacttgattttagatttccctcagccttcaaccgattacttaagtttccggagccactttcagaagaactttgtctgtctggagaactgctcgttgcaagagcgaacagtgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatgtgccatggtggaaaagtactatcggaataactctgcagtgacagaatttgaagtttggctagcatccatacttttctactgtaaatatttcactctcctctagctatccttgatgagcttctcactttaagaataaatgtgtttgatataaggcctgagtatattttctttctcaaagccacagtcaaataagaaactcaactgacattctcatttttcatttaggaacaactgagcagagttagtatggaccaagacatggatccatctgaggatattcacaaggccccag

SEQ ID NO: 444451 - DNA, 1190 bp, Homo sapiens
agcggagtctctcccagcgaccgccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaaaacaccacgaggagaaaaacttgattttagatttccctcagccttcaaccgattacttaagtttccggagccactttcagaagaactttgtctgtctggagaactgctcgttgcaagagcgaacagtgacagggactgttaaacctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcctggctatttatctggggtctttttttaaaaatggtgtactggtgaggggataaag

SEQ ID NO: 444452 - DNA, 2545 bp, Homo sapiens
agcggagtctctcccagcgaccgccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaaaacaccacgaggagaaaaacttgattttagatttccctcagccttcaaccgattacttaagtttccggagccactttcagaagaactttgtctgtctggagaactgctcgttgcaagagcgaacagtgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatggaaagctgtgttaatggtatgaggaatgtgtgaaaagtatacacaaagggctctgaagctcaagtcagaggagtgggaggtctgatcattgttggtggaaaaacgtaaggttattttgtgtttttaagttggttttacaattctttcctggggaaattatttctggaggggaaaaagatccattctacgtatccttgtggagaaaagctaaataacctttaagaatgtgggtggtattggagaaagaagatgaattatagctccggagaatcaagatcttaagtgaagcctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatggatgtgacttgttttgaatgttttgtattatacttgtttttgtgtgtgcataaattcattctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagaatttgaagtttggctagcatccatacttttctactgtaaatatttcactctcctctagctatccttgatgagcttctcactttaagaataaatgtgtttgatata

SEQ ID NO: 444453 - DNA, 2687 bp, Homo sapiens
agcggagtctctcccagcgaccgccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaaaacaccacgaggagaaaaacttgattttagatttccctcagccttcaaccgattacttaagtttccggagccactttcagaagaactttgtctgtctggagaactgctcgttgcaagagcgaacagtgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatggaaagctgtgttaatggtatgaggaatgtgtgaaaagtatacacaaagggctctgaagctcaagtcagaggagtgggaggtctgatcattgttggtggaaaaacgtaaggttattttgtgtttttaagttggttttacaattctttcctggggaaattatttctggaggggaaaaagatccattctacgtatccttgtggagaaaagctaaataacctttaagaatgtgggtggtattggagaaagaagatgaattatagctccggagaatcaagatcttaagtgaagcctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatggatgtgacttgttttgaatgttttgtattatacttgtttttgtgtgtgcataaattcattctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagaatttgaagtttggctagcatccatacttttctactgtaaatatttcactctcctctagctatccttgatgagcttctcactttaagaataaatgtgtttgatataaggcctgagtatattttctttctcaaagccacagtcaaataagaaactcaactgacattctcatttttcatttaggaacaactgagcagagttagtatggaccaagacatggatccatctgaggatattcacaaggccccag

SEQ ID NO: 444454 - DNA, 2023 bp, Homo sapiens
gttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctgggatttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttcta

SEQ ID NO: 444455 - DNA, 2049 bp, Homo sapiens
cggcactcgtttttaatttaatgcagcgggcgggggtttaattgtaagactgtgccgtggtgcagacaatgtaaataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctgggatttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttcta

SEQ ID NO: 444456 - DNA, 1969 bp, Homo sapiens
gttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctgggatttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttcta

SEQ ID NO: 444457 - DNA, 1966 bp, Homo sapiens
gttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctgggatttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttcta

SEQ ID NO: 444458 - DNA, 2248 bp, Homo sapiens
gttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctgggatttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcacacagtgtaacttgcaaaaagattccatctctgagatccgaaagacttttaaggttatcagtccaatgaacccctggtgtaacaagaagtcccgtgcttttgtcattaggcgggtctttcccaaggtatccttgc

SEQ ID NO: 444459 - DNA, 2696 bp, Homo sapiens
gttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctgggatttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctaaaaaaaaaaaaaaaaaaaaaaaaaaaaaaaaaaaaaaaaaaaaaaaaaaaaaaaaaagggggggggccgccgcgcgcccaggaagaaggagtataaagcacaaaaccacaccggtgggggggggcggggccccaacaaagaataaatgaacaaacggcgcaactaagatcccccatcgagagcaaaaagagtggagttagatgcacaacgcaggcggcgggttttctcccacaacaaaaaaaaaacacgcgccgggggacacgacacgacggcattctgaacaacaacaaaaaagtgctccggcgaccccaccggggaatcacaaacacgaggccaagagccgtgataaataaataccgcccgggggggcgcgggaggagccagacccaaaccgcacccaaacaaccgcacaccggcggaccaccaccgacacggacgcaaacagactacatgaagcgtaccctcactcacccactacaagcccgcccaaccaaaaccgcaacagtaagcagacccaacacatcaccaccacaaacccacgcacagaaatacagtgatcgaacccagacgtgcagatccccaaagctacaaaaaacaacacacagagcacacaagatcaaacaacgatgagcccatccacctaacgacaaaaaacacaatgatacgtgctaaa

SEQ ID NO: 444460 - DNA, 1661 bp, Homo sapiens
ggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaact

SEQ ID NO: 444461 - DNA, 2398 bp, Homo sapiens
ggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgtaacttttcacataaagagaatgcatctttgacagttatcttatttgtaaggcagcctataaaatagttctgaagtattttatttacctaactataattattgggccagatacttgttaataaatgggcttaatgttaaaaaaaaagaacaaaataaaaaaaaaatacacgaatagataaaaaggaaaatgaaaatctcacataaaattaaaaaattaaaaaaaaaaaatgagatgggcgtgtggccccatgccactaatctaatctaaaaaggaggcttttttagaagaatttttaccttcctgccactgtggcggatgtaactatatcgagaattaaactactttacttccgccctggattacaccccctatttgtctcgataaccaattggttgaattaatttattgccggtggggcctccttccgcctaggtgatatttgaatatacgcaagaatatcaatgccgttcgcgcttttaacttctataccaagcgttgtgatttgg

SEQ ID NO: 444462 - DNA, 1210 bp, Homo sapiens
ctgcctcctgttgactctgccggcctcgggatcgtgcctcatgaaagtcatctacctgatcttggtagtagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgtaacttttcacataaagagaatgcatctttgacagttatcttatttgtaaggcagcctataaaatagttctgaagtattttatttacctaactataattattgggccagatacttgttaataaatgggcttaatgttaa

SEQ ID NO: 444463 - DNA, 554 bp, Homo sapiens
gtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgtaacttttcacataaagagaatgcatctttgacagttatcttatttgtaaggcagcctataaaatagttctgaagtattttatttacctaactataattattgggccagatacttgttaataaatgggcttaatgttaacatggatttcatatgttctgtgtggtttaaaagcataggaatgaaactttggttaaaagcagaaaaagga

SEQ ID NO: 444464 - DNA, 2029 bp, Homo sapiens
ggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgtaacttttcacataaagagaatgcatctttgacagttatcttatttgtaaggcagcctataaaatagttctgaagtattttatttacctaactataattattgggccagatacttgttaataaatgggcttaatgttaa

SEQ ID NO: 444465 - DNA, 1098 bp, Homo sapiens
  misc_feature (996)..(996): n is a, c, g, or t
ggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtactcggccgcgaccacgctaagccgaattncaacacactgccgcccgttactagtggatcgagctcggtaccaacttggcgtaatcatggcatagctgttcctgtgtgaaattggtatccgctcacaattca

SEQ ID NO: 444466 - DNA, 1975 bp, Homo sapiens
ggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgatcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgtaacttttcacataaagagaatgcatctttgacagttatcttatttgtaaggcagcctataaaatagttctgaagtattttatttacctaactataattattgggccagatacttgttaataaatgggcttaatgttaa

SEQ ID NO: 444467 - DNA, 1489 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtcagcttggggaacgggaacttgccttccgttgccggaggggaaagagccttaagggggggcaggcacagcgtccggcggtttgggggttgc

SEQ ID NO: 444468 - DNA, 1368 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcaaattgggccaagaaaatgtcagagaaaagaaccttttcctttaagcggcccaaaaagggcctttttttggggggcgccccagggggcccccaaaaaagggaaaacaccattttgtggcggacggggcttggagggaggctatcttcccgagtttaatcaaggagcagggggggagggaatattaaaaacagccgcgcttattaatttatacagtagccggggcgcggggggcgagcacaaactttcttttttatagaaagaggagagcgccccctcccaagatagaagaacaaataccagtggtggggtgacgcaaaaaacaaagcagcgggggggagagaggaggagggggaattaattttataacaacagaaccagagcagcactcgagcgcccagctactaaaaataaagagaggagcgtgtat

SEQ ID NO: 444469 - DNA, 610 bp, Homo sapiens
  misc_feature (8)..(8): n is a, c, g, or t
ggggtctntgctcttttggggtctttgctcttttggggtctttgccttttggggtcccgactcatttggggtctgtgctcttttagggtctttgctcttttggggtctttgctcaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtac

SEQ ID NO: 444470 - DNA, 877 bp, Homo sapiens
tgttctattttgtattttttttttctcttagagactaccataaaatagcatttttaaaaatttatttttagagatggaggctctctgtgttgcccaagctggacttgaactcttgggctccagcagtcctcccacatgagcctcccgagtgactgggactccaggtgcgtgccaccaagccaaacttccctttcagttcttgacattccttttctgctttgtatcatgcatctccccagatctcccctaacttcattcaaccatgtagttttataagggccagcagactatctaggaagcaggagtagcatgactttaaagtgattctctgtgccaatctctgcaactggttcctttggcaggctctgacagattaccgggcagagctccgggatgacccaatcatcagcacacacttggccaagttgtatgataacttactagaacagaatctgatccgagtcattgagcctttttccagagtacaggtgagaaccctctggggactccatttctggccaggcattctcactgtagccacctcccttccacacctgtccagaatgggaactcacttctaggggtgtgcctggtgggcaagaggccaccaagagcttgggcctctgttgataaaatgaacaaaaatcgaggagagagatgctgtgggtagaggcatgtgggttgcccctgcatgtgttctgagcagtttcctcctcgcttttagtcactgcatgtgttgtacctgttttctgtattgggtgtgtgggataagagtctgtttattgtgtgtagcagtgaagggcaggcagatgggcagagaacaagagacttaagcacggccaaggagggtcttacattagaattttgagaaatacag

SEQ ID NO: 444471 - DNA, 733 bp, Homo sapiens
cattttggtgttctttcccctaccatacggcctgtctgcccttccctccccacattggctccagcagagtagccgaaggtcctgccgccgccgccaccaccaccaccactgcagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggcgacgtggaaaggaattatcacagatgatcttgacagaattcatgggattggaccagggagggtgtctgattattcgatgacccagtaataactacgaagtgcggacatccactgagcagttggtcctttaaaagcagaatgataaatggctggggcttggaaggttggggagaacggggagcgagactggccgagaccttgggttgccagggttgccggggggtcacaacatcaacctgggtgcggtctttcttctgtccgcaccccccaaccc

SEQ ID NO: 444472 - DNA, 572 bp, Homo sapiens
atcatattctgaaaatcaagcagagcctgaacagagcgggcgcgaggccaaaaacagtgctctggaaggtcattctgtagttattttcaacaggctatataacatgccaatcattatgcttatcatagacaggcttaaattgaaattataactgaatttctaatgagttcttcttggctaagggtgaaacaaatgacctgaatgctgatgaacattttggggtgtgcttgcacaccctcccttccacacctgtccagaatgggaactcacttctaggggtgtgcctggtgggcaagaggccaccaagagcttgggcctctgttgataaaatgaacaaaaatcgaggagagagatgctgtgggtagaggcatgtgggttgcccctgcatgtgttctgagcagtttcctcctcgcttttagtcactgcatgtgttgtacctgttttctgtattgggtgtgtgggataagagtctgtttattgtgtgtagcagtgaagggcaggcagatgggcagagaacaagagacttaagcacggccaaggagggtcttacattagaattttgagaaatacag

SEQ ID NO: 444473 - DNA, 3609 bp, Homo sapiens
  misc_feature (3596)..(3596): n is a, c, g, or t
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttttttttttttttttttggggggaccctctaaaagccgcccggcgggcttgcaacttgggcacgggccgccgtttaaaagggccgggccgggaaaaccccgggggggnggggcaaacgcgg

SEQ ID NO: 444474 - DNA, 3283 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtac

SEQ ID NO: 444475 - DNA, 2283 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactaaaaaaaaaaaaaaccacaaaacaaacaaaactgttgtgtgggcgcgcccggggcccccggaaaagagtttttaacaccattccgtgggggcgcggggcccccgtggggtgcggcacccggggccatggcgggcccccggggaac

SEQ ID NO: 444476 - DNA, 3582 bp, Homo sapiens
ctccgaggatccgttcggcagtattaggtctgtttcttgtattggaagcgctctgggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444477 - DNA, 3394 bp, Homo sapiens
  misc_feature (19)..(20): n is a, c, g, or t
taagcaggctggtacgccnnggaggtaatggatatcgtcgacccacgcgctccgggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444478 - DNA, 3357 bp, Homo sapiens
tgtcgagtaagttatcatacaacttggccaagtgtgtgctgatgattgggtcatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444479 - DNA, 1948 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggcgacgtggaaaggaattatcacagatgatcttgacagaattcatgggattggaccagggagggtgtctgattattcgatgacccagtaataactacgaagtgcggacatccactgagcagttggtcctttaaaagcagaatgataaatggctggggcttggaaggttggggagaacggggagcgagactggccgagaccttgggttgccagggttgccggggggtcacaacatcaacctgggtgcggtctttcttctgtccgcaccccccaaccc

SEQ ID NO: 444480 - DNA, 1721 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaagcttgacagatacgggcgagctccggatgaccatcatcagccaccctggcagtgttgtactactacgattgtcggtctggctttcagtcgtggcctttttcttcactccagcccggggatttcctttcaaatgggttgcggggggggtttgccccaatggtcgacagggcccaaatttgggggggggagtttcccttcgcttcatagcatcc

SEQ ID NO: 444481 - DNA, 3287 bp, Homo sapiens
tgttctattttgtattttttttttctcttagagactaccataaaatagcatttttaaaaatttatttttagagatggaggctctctgtgttgcccaagctggacttgaactcttgggctccagcagtcctcccacatgagcctcccgagtgactgggactccaggtgcgtgccaccaagccaaacttccctttcagttcttgacattccttttctgctttgtatcatgcatctccccagatctcccctaacttcattcaaccatgtagttttataagggccagcagactatctaggaagcaggagtagcatgactttaaagtgattctctgtgccaatctctgcaactggttcctttggcaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444482 - DNA, 2949 bp, Homo sapiens
tggcctcattggaaagctccccagcttctcagtggggaatgggcagtgtggactagagtaggagttgcattgttgctattttgttttcagtccatttggcctaagacccctccaacaaagctactgtgtcagggtgatctctgactagtggatactggtccctttaatcatgtgctttgattttaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444483 - DNA, 2871 bp, Homo sapiens
  misc_feature (37)..(37): n is a, c, g, or t
cttcaagatatcggcccaagggcaaagctcggattgnaaccattcatcagcacacattggtccaaagtccagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444484 - DNA, 2992 bp, Homo sapiens
  misc_feature (37)..(37): n is a, c, g, or t
cttcaagatatcggcccaagggcaaagctcggattgnaaccattcatcagcacacattggtccaaagtccagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacataggtgagtgctggcttcaggaccccagggctgggcagctctgtcttctgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444485 - DNA, 1762 bp, Homo sapiens
  misc_feature (8)..(8): n is a, c, g, or t
ggggtctntgctcttttggggtctttgctcttttggggtctttgccttttggggtcccgactcatttggggtctgtgctcttttagggtctttgctcttttggggtctttgctcaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444486 - DNA, 1813 bp, Homo sapiens
ggctccttgggttgagagaggccagacttgcagtcatcttcgataactctatttctctttttctttctctcttcctctttctccctcattcttatctttcctctttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444487 - DNA, 291 bp, Homo sapiens
gccatctactgcccccctaaattgcaggccaccttggacatgcagtcgggtaacagacgtagctattcctgggatgtgttttcttaaagctcatcttattttataggtggaaggaatgggggttggggctggagaataaaattggctgatttggctctagcttcttcagagaaccagttagaaagctacctttctaactagctgctcccctcctgttaactgcctaaaatgtattaagaacatacctatctgtggttgaccaggcaatctgacttttagaaccaaacttag

SEQ ID NO: 444488 - DNA, 1385 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttcttaacttgttggggggagttgaaaaagattggccaccaaaagcccttttggggggaaggccaagtttttagaaagcaaaaaaaacccattccctgggcaaacctgcccaaaggcccagagttgcttataatttttgtttaaacccacaaaaatggcccttttttggccccctaaaatggggggcccctttggaataccccggcggggttttttcccctcgcccaaaaaaaaagggcgggaaaaaccggcccttacctttttttgggggtttggggggggttgtttctttgaggggccccagggccaaatttttgtgagaagtggtgggtggggaa

SEQ ID NO: 444489 - DNA, 1625 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcggtaaaggtcgccgcgccgcctccccggccccgccggcccagctcggcttatgtcggtcggcggcagcggagaggggcccggctagccggctctgatgctgctgactcactgtgtgaggggggccgggccgggggcgcaggccgctcggagctccccagagcctcccaggtctcactcttgtgggagggcttgaggcaatccccgggtcccctcgccggctgctgactcacggggggctcagcgtagggtgggagagtgggccgagccgggcccccggggatccctccctagccatgtccccggctctggcccgcacgagctggtctgggacccggagcagtgccggccggcgtgcttgtcacggactggtcctagagtctctacttgaaaggccttggcgaaaccagctctggacaggcatttcccgccgttgtaatcagcacagcctgctccgggtgggagcgcgagcgcttgctcttctctgggagtttccttccacgggacgctgggagctgctactcctcagccccacggcagaaagctccactaagaggagggtctctttcagaatgtgggaaattcaggggtgacacacacctcagattggcatttggtttgtggaggtggccgagacgctcatctgctctgtgtagggtgtaagagtgaggtgttggagcgggaccgcctggctagaggaggtgactaatctttccagactgcctgtaggggttggaagtgagttaagggagttagttgtcagccgcggagttcagggaattctttggaacgggtcggctgcatgttgccggaaaaattaaaatttcttaacgctgtaataacgatggtcttacacctacacacaacaggaaaactgaaatgggaatcccagccagtcgcttccggcagctttctgttgggattcaagtgtgaacagaa

SEQ ID NO: 444490 - DNA, 4435 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444491 - DNA, 3269 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttactgtaacccaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggttt

SEQ ID NO: 444492 - DNA, 4556 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacataggtgagtgctggcttcaggaccccagggctgggcagctctgtcttctgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444493 - DNA, 3693 bp, Homo sapiens
tattgattatctgcggaagttcggtcatcaggaggtcgtatatagtacatcgtgtcgtatagtacgaccctatcttgaatcccattacgtgaaggatatccactcaccgcgggggccgatctctccttgatctagtagctcgatattggacaccagtatatgagtcgtattacacgaccacgggtcgtcagttgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataattttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcaaa

SEQ ID NO: 444494 - DNA, 1938 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccaatgggagggggtccctgttattttagatgaaccccttgtgcattaaaatttcaaatctgctatggaatccattttatacgtgggccatttaatgggattccctttagaacaaagccaataaacttccctctttgtgtgatttcttctcgtccttttataatttttttttttacgtttaatttttactctttgtggatattt

SEQ ID NO: 444495 - DNA, 2025 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacaggtgagaaccctctggggactccatttctggccaggcattctcactgtagccacctcccttccacacctgtccagaatgggaactcacttctaggggtgtgcctggtgggcaagaggccaccaagagcttgggcctctgttgataaaatgaacaaaaatcgaggagagagatgctgtgggtagaggcatgtgggttgcccctgcatgtgttctgagcagtttcctcctcgcttttagtcactgcatgtgttgtacctgttttctgtattgggtgtgtgggataagagtctgtttattgtgtgtagcagtgaagggcaggcagatgggcagagaacaagagacttaagcacggccaaggagggtcttacattagaattttgagaaatacag

SEQ ID NO: 444496 - DNA, 1769 bp, Homo sapiens
ccaaggttaaatgggcgcgtgaggacagttttctccggtcctggcgggtttgcccacctgccggccagcgttctgcgggagtcaagcctggaaagcgtgtgtgcggcgcacaggcgtcagacaactggaacgcattcgaatggtgctattctttgcccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggccgccgggtcctccaagcctggaggggctgaaa

SEQ ID NO: 444497 - DNA, 819 bp, Homo sapiens
gcggctgtctagaggatccctcataggttcgcaggcacacctgtgcagatgaatccagccttctctaggggagagagggtatcccggcttaagagcagggctctcctgagttaaggaagtgtcttccccagagcccattccgtcagacgttcatatcatgtaactcagtccttttctgattatgtattcaccaagcaaacttaagagttggcttgtcaccagacctacaccctgcgaacctatgaaggttcgcagggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgtcgaacctatgaggtaccgagctcgattgtatatgtact

SEQ ID NO: 444498 - DNA, 143 bp, Homo sapiens
gcggccgcctactactactactactgctcgaattcaagcttctaacgatgtacggggattaacagcatctgcttcattcccctcaccttcccaggctgatctgaggtaaactttgaagtaaaataaaagctgtgtttgagcat

SEQ ID NO: 444499 - DNA, 2310 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444500 - DNA, 2370 bp, Homo sapiens
gcggctgtctagaggatccctcataggttcgcaggcacacctgtgcagatgaatccagccttctctaggggagagagggtatcccggcttaagagcagggctctcctgagttaaggaagtgtcttccccagagcccattccgtcagacgttcatatcatgtaactcagtccttttctgattatgtattcaccaagcaaacttaagagttggcttgtcaccagacctacaccctgcgaacctatgaaggttcgcagggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444501 - DNA, 1941 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcat

SEQ ID NO: 444502 - DNA, 2308 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcagaaaaggagggagctactctaaggctgagtggagcgacagctgcccagggctctgagtctcacagcttgtaaagccctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444503 - DNA, 2252 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcagtctcacagcttgtaaagccctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444504 - DNA, 1872 bp, Homo sapiens
cgagctcggtaccctgtggagaccgggtctccggggtctgagtctcaccgcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444505 - DNA, 2276 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatctaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444506 - DNA, 1683 bp, Homo sapiens
  misc_feature (20)..(20): n is a, c, g, or t
agatacagggaaggaacacnggtcaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444507 - DNA, 1836 bp, Homo sapiens
ttacagtcttatgagacactcacgcagaagattagctaagccgtgtccagattcctaatccacataaattgtgagaaaaatgtgctgttttaagctggcaagtttgtagtaacattgctacacagcaaaacataactaatacaccttgctttccgactactgtagtttccgtaagcctgaagtccttaagacaagtgatcagtgaagagtgaagcaacctttaccctaatacatggttgccactcctggcagtcccaaataagctttaaaaaccctcttctgccgggtgtggtggcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444508 - DNA, 2256 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagagggctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444509 - DNA, 1929 bp, Homo sapiens
  misc_feature (18)..(18): n is a, c, g, or t
  misc_feature (1922)..(1924): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctgcgggggctggccaccataatctttgattacccttcaagtaaaatacacgctgtgtttgtgacccnnnggggg

SEQ ID NO: 444510 - DNA, 2261 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444511 - DNA, 1485 bp, Homo sapiens
  misc_feature (1)..(1): n is a, c, g, or t
  misc_feature (22)..(22): n is a, c, g, or t
  misc_feature (36)..(36): n is a, c, g, or t
  misc_feature (81)..(81): n is a, c, g, or t
  misc_feature (83)..(83): n is a, c, g, or t
naactgagctagcatgcccagnccacagagagcctncactagagtgatgctaagtggaaatgtgaggtgcagctgccacananggcccccaccagggaaatgtctagtgtctagtggatccaggccacaggagagagtgccttgtggagcgctgggagcaggacctgaccaccaccaggaccactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444512 - DNA, 2175 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444513 - DNA, 1806 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcat

SEQ ID NO: 444514 - DNA, 894 bp, Homo sapiens
tgaggggcgagctgctaactcaggggcgagctgctaactcaggggcgagctgctaactcaggggcgagctgctcgctcaggggcgagctgctaactcaggggcgagcagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444515 - DNA, 769 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtg

SEQ ID NO: 444516 - DNA, 1525 bp, Homo sapiens
  misc_feature (18)..(18): n is a, c, g, or t
  misc_feature (772)..(772): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgaanaaaaaaaaaaaaaaaaaaaaaaaaaaaaaaaaaaaaaaaaaggggggggcagcagaaaaatatccccgaagggaggccaaaaatgaacggatacccagagattttgtagaacagagggcggcccaaaaaggagagcgcataaaaaagagaagacacgcggcagagcttaacacaacgctagagagctgggaaacaagcgcagacacacgagagaacacgacggcgaagaagcccccaacacgcgaggaggggagacacaaacaggcgggaacaagcacccagacgagaaataagagcgccagaggagaaaatagaacatagagagcagatcaagggggcaccaccgggacaaaataggtgcgaggggcgtggaaaagcttatgtgctccccggcgacgaagtatatatagagaaaataatggacggagggggcagtaaacgcaagctatactgcgcagagactggagagtaatccagatccaatagctatacacaagacgtgacttagataaactaaaacgacgacacaaacaatactcaatctaaaactaattaataacgctgatattacactcgaaccacagatttatataataaaacacctgtacacacaaacaataaaaaacataaacaatccacaaaaacaacactacacaatctacaatatgaactaccatacataagaacaataaagcacatacatgcactagagacacaaataagaaaagaaccacaaagaaaatacacactaca

SEQ ID NO: 444517 - DNA, 818 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttgtgatctgcctgcctcagttcccaaagtgctgagatgacaggtgtgagccatcagacccagcatttttttttttaaatttaaattaaaacttaagc

SEQ ID NO: 444518 - DNA, 689 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggagtaaggagggggatgggaggtcatgtctcttctcagggaaagcgggagcccttctggagcccttccgcagggtcagggctgaggcctgggggtcagggccccttacgttcccctccccagagccggcttcccagcccaccatccccatcgtgggcatcattgctggcctggttctccttggatctgtggtctctggagctgtggttgctgctgtgatatggaggaagaagagctcaggtggggaagggagaagggtggggtctgagttttcttgtcccactgggtgtttcaagccctaggtaaaagtgtgtcctgcctcgttactgggaagcaccatccacacacacgagcctacctcgtgccgaattcctgcagcacgggggat

SEQ ID NO: 444519 - DNA, 422 bp, Homo sapiens
gcccctcacaggacattttcttccaacaggtggaaaaggagggagctactctaaggctgagtgtaagtgcggggctgggagcgtggaggagctcgcccaccctataattcctcctgcaccacatctcctgtgggctctgaccaggtcttgtttttgttctaccccagggagcgacagtgcccaggggtctgagtctcacagcttgtaaaggtgagattctgggggtctgaagtgggtggagggtggggcagaggggacaggactgggttgtggggattttttgattcagaatttttgagtgtgtggtgggctgttcagagtgtcatcacttaccgtgactgacctgaatttgttcatgactattttcttctgtagcctgagacagctgccttgtgtgcgactgagatgcacagctgccttgt

SEQ ID NO: 444520 - DNA, 2330 bp, Homo sapiens
ggacaccattgagaatgtcaaggctaagatccaagacaaggaaggcatccctcctgaccagcaggggttgatctttgccggaatacagctggaagatggtcgtaccctgtctgactactacatccagaagtgcgcctgggtgcgcacccaggcgcacttctggaaggttccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444521 - DNA, 2461 bp, Homo sapiens
tgggtgactctgaggatcccaagctctggaaaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggagtaaggagggggatgggaggtcatgtctcttctcagggaaagcgggagcccttctggagcccttccgcagggtcagggctgaggcctgggggtcagggccccttacgttcccctccccagagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444522 - DNA, 2415 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtgtaagtgcggggctgggagcgtggaggagctcgcccaccctataattcctcctgcaccacatctcctgtgggctctgaccaggtcttgtttttgttctaccccagggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444523 - DNA, 2237 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaagcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444524 - DNA, 2120 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcataaaaataaaatggcactctaattaaactgctttacagcctgcaggacaccttagggccagcttggtaatactctagattccactgtcgtcccaacccagattcttccacctcacttattccttcaccaacatgcaagtcctttccttccctgccagccagatagatggacagatggcaa

SEQ ID NO: 444525 - DNA, 2088 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggagtaaggagggggatgggaggtcatgtctcttctcagggaaagcgggagcccttctggagcccttccgcagggtcagggctgaggcctgggggtcagggccccttacgttcccctccccagagccggcttcccagcccaccatccccatcgtgggcatcattgctggcctggttctccttggatctgtggtctctggagctgtggttgctgctgtgatatggaggaagaagagctcaggtggggaagggagaagggtggggtctgagttttcttgtcccactgggtgtttcaagccctaggtaaaagtgtgtcctgcctcgttactgggaagcaccatccacacacacgagcctacccagcctggggccctgtgtgccagcacctactctttttttttgagacggagtcttggctctgtcacccaggctggagcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444526 - DNA, 1863 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcat

SEQ ID NO: 444527 - DNA, 1747 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagaggctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcat

SEQ ID NO: 444528 - DNA, 2207 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagagggctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtgtgcactctagccgtgtgcactctcatgcagtaccgag

SEQ ID NO: 444529 - DNA, 759 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgtcgaacctatgaggtaccgagctcgattgtatatgtact

SEQ ID NO: 444530 - DNA, 738 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtcgtccggcgtgtcctgctacctgtcctctgtcctggctcaagctattgggtac

SEQ ID NO: 444531 - DNA, 695 bp, Homo sapiens
  misc_feature (18)..(18): n is a, c, g, or t
aaacagtccacctctgtntctaccatgacccccttcctcacactgacctgtgttccttccctgttctcttttctattaaaaataagaacctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggggaagggagaagggtggggtctgagttttcttgtcccactgggtgtttcaagccctaggtaaaagtgtgtcctgcctcgttactgggaagcaccatccacacacacgagcctacccagcctggggccctgtgtgccagcacctactctttttttttgagacggagtcttggctctgtcacccaggctggagtgcaatggcgtggtttcagctcactgcaacctccgcctcccaggttcaagcaattctcctgcctcagcctccctagtag

SEQ ID NO: 444532 - DNA, 817 bp, Homo sapiens
gggggcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaagtaagtataactattgaatgtttctgggttcagctaaatactctaaaaaattgaatggcttcactaaatatagtattctgggtaggatagtatgcaaaaggttgtattctagtttgtctgtagttactgataacttcagcatagtatgcctcttaataatgctgacttagcactcaattctgccaactccttttagacaaatttgccaagacaattaggtattttcatagatcattatggagataaaattaaacattgtgctgggattctgatatgtaaaaattttaaaagtaagccaaatattttaatatgtacattgccattttgaaatctgcctaaagaatgtatttttctacacttggatgtaacaagtatgattcattcattcaattaattaaattatctttcatacattcatcattcatctcacccttatgtagaggacattgtagaggtaccaaggattc

SEQ ID NO: 444533 - DNA, 1412 bp, Homo sapiens
gggggcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444534 - DNA, 1278 bp, Homo sapiens
tagatggcaacctccctatctgcccgcaggtcatagaggcgacacgtagcgtcatctgaccctgaagcaaaggcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacattctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444535 - DNA, 1726 bp, Homo sapiens
ctctaaagagtgagattattcttttctccccacagacaccctaaggagctttacttgggaatcacattgttcactctagctcagctgactttgtttataattcagctaaacaaataaatggtatagatatggaccataaatggtgccatataaaagtctcagtgaatgctagcaaacataattagtacatcaggcctacagatcatatataggcctaacattttctggctaatataaattagatggggaaattatatttactaattattgtgatgttaatgccttttgtcagtgtttgctttcctaaaatactctctactctggctaagatttggcatatataaaagatggttttatattcagtggagcagaatttcaattcaaaccgcggatagaagcaaaacagtttggtagccaccatcaagtagcaatgtgactatgaatgagtttgtctggccccagattcctcttctatgaatgaagaaatttcaaatgacttctcatctctacaatctataacacagctatttcagcagtagctgtctcttacctttgtatgaataggaagcaattgtatttttcttacaaatttcttcttcaaattattcatttgttggttcatttaatttaattatctccccacccacccctcgtttctttttagctggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444536 - DNA, 1356 bp, Homo sapiens
tagatggcaacctccctatctgcccgcaggtcatagaggcgacacgtagcgtcatctgaccctgaagcaaaggcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataaggtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444537 - DNA, 1358 bp, Homo sapiens
gggggcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataaggtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444538 - DNA, 1454 bp, Homo sapiens
aagagactgattttacaaaaccagctgccatgatgagggtgagggaagggttaagggtattgttactgaccagaactgcatgtcagggagtccttaatgagtgctcttgttttggataagaaaatgcagattagcataatgtatacaattgcagcagcaaaagtatttccaattaacagtattaccagataaatattcttggtccaagcagaaaatatcaacaaaaagagccttcttctcctgtaaatcttaaatgcctacatcactctttatgatacatggatcatcttatgtggatacttaaatttttcatgtctgcttcttttgcctctcctaactatactatgaggaaatttggaacaaagacatttttgtaatatttcttatctccttcacacctagtatagagctgattttacaaaggcatttaagagatatttgaattgatttaaatgaggccttaaaattactttctgaggtgtttcaaaaaacagtaacatcataaaatttgcagtaaagaaaagtatatattagctaacaaggttttcttttttagatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444539 - DNA, 1672 bp, Homo sapiens
ctctaaagagtgagattattcttttctccccacagacaccctaaggagctttacttgggaatcacattgttcactctagctcagctgactttgtttataattcagctaaacaaataaatggtatagatatggaccataaatggtgccatataaaagtctcagtgaatgctagcaaacataattagtacatcaggcctacagatcatatataggcctaacattttctggctaatataaattagatggggaaattatatttactaattattgtgatgttaatgccttttgtcagtgtttgctttcctaaaatactctctactctggctaagatttggcatatataaaagatggttttatattcagtggagcagaatttcaattcaaaccgcggatagaagctggccccagattcctcttctatgaatgaagaaatttcaaatgacttctcatctctacaatctataacacagctatttcagcagtagctgtctcttacctttgtatgaataggaagcaattgtatttttcttacaaatttcttcttcaaattattcatttgttggttcatttaatttaattatctccccacccacccctcgtttctttttagctggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444540 - DNA, 714 bp, Homo sapiens
atattttaatacaaaatccacatttattattagcaccaatgatttaacttacaaatatattatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444541 - DNA, 1358 bp, Homo sapiens
gggggcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattacaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444542 - DNA, 487 bp, Homo sapiens
tagatggcaacctccctatctgcccgcaggtcatagaggcgacacgtagcgtcatctgaccctgaagcaaaggcgcagcagccatctccactccaaagttagacaaaatgccaggaatgttcttctctgctaacccaaaggaattgaaaggaaccactcattcacttctagacgacaaaatgcaaaaaaggaggccaaagactttgccttttggatgggtattaaagcatacccctaggtctatgatcccacacactctgggatctttgagattaaatttttccacagtgcccaggggtgtactctctttgcttcttctgagtgatgtgcaatggctcactctctcggggaaactcctttgccccacccactcgtaaaaaatttgtcttgggggagtccccaagggtctatcaccagtggggggtattgtggggttctcggccttctgatgaggactttagaacagcggcgtctcttctttccccct

SEQ ID NO: 444543 - DNA, 278 bp, Homo sapiens
agcagccatctccactccaaagttagacaaaatgccaggaatgttcttctctgctaacccaaaggaattgaaaggaaccactcattcacttctagacgacaaaatgcaaaaaaggaggccaaagacttttgtaagtttgttcagagtctcactttgtgaattttaacaagttatctttaatggcagaaggattgagaatgaatggaagagagtgtgagcatttagtttagccagatcagaggagttaattgcctgttgtgagtaataagtaatattca

SEQ ID NO: 444544 - DNA, 1410 bp, Homo sapiens
tagatggcaacctccctatctgcccgcaggtcatagaggcgacacgtagcgtcatctgaccctgaagcaaaggcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444545 - DNA, 1396 bp, Homo sapiens
  misc_feature (1)..(1): n is a, c, g, or t
  misc_feature (7)..(8): n is a, c, g, or t
  misc_feature (21)..(21): n is a, c, g, or t
  misc_feature (24)..(24): n is a, c, g, or t
ngggggnnaaaaaaacggcgnaangggggccgggccctctttcgacccacgcgtccgggcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444546 - DNA, 1358 bp, Homo sapiens
gggggcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444547 - DNA, 1331 bp, Homo sapiens
gggggcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagactttactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444548 - DNA, 1359 bp, Homo sapiens
gggggcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcagtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaat

SEQ ID NO: 444549 - DNA, 2182 bp, Homo sapiens
  misc_feature (1)..(2): n is a, c, g, or t
  misc_feature (4)..(5): n is a, c, g, or t
  misc_feature (9)..(9): n is a, c, g, or t
  misc_feature (12)..(12): n is a, c, g, or t
  misc_feature (14)..(16): n is a, c, g, or t
nncnngagntgngnnnggaggtgggagatcttcaaagggattcatgaggcctgttcctgtgagaggggtccattcactccacccccgcccctttggggggcctgtttctttgccttggctcagaactgggaggtgcagatggggcctcggactctacagacagcccagcctcctgccagaagaaatctgcggggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagt

SEQ ID NO: 444550 - DNA, 510 bp, Homo sapiens
gttggcctcaaactgtgatcacccacacacccactttctgttgggtggcggctctaagaggagctccactggattcctgaacaggagactcaccccctcccctggccctgggcagagggagaacctgggccctgggtcagtggccccagcgcagtgtctgcctcccacaggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggtaaggccttcctgtctcagggccccaaacccaacatggggagggaactgcagaaggaaagaggcaccattctga

SEQ ID NO: 444551 - DNA, 515 bp, Homo sapiens
ttactccgttcccactcttggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctgggggctggcagaggcccccatatactctgctacagctcctatcatgaaaaataaaatgtttgtctttgcaaaacagt

SEQ ID NO: 444552 - DNA, 3417 bp, Homo sapiens
agcgtaggttcagcccatctgcagggctcctgggagtcatgggggcctgaagggatcctgatccgacagctcagtcagaacggcctggctgggaaggcagacggaatgtgggccagcctatgcccaaagcctgcaggggtcagctcattggctactttaagtgaccaaagaccctaccatccaaggacatttctgtatccttaccatcccttgaggattaggtgggcatgcactttgctgtgggctgtagggggtggggtatgcagtgttctatttggcctttaaagccatgggaacccagatcaccagatccggagcctgactctagcccctgagccacctgttgccctaacaccctgtctgactctctcccgctgcagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagt

SEQ ID NO: 444553 - DNA, 3331 bp, Homo sapiens
gcgcacatttacttagcctagtgatattcccatcctgctttggtcccataatatcaccaactatacccccagatcttatcaaattctgcaaaatattcctaaaacaaaattcattttaattccatagactactagaacattaaagaccctcagaagctgtttagtccacttggtcccctctgagcttcagttatcccatatcagagtcaagatccaggctcccgcctcccaggggcatgtttttctgcccagatctgctattttcctctccttcacgttttctgccattttcttttccaagctgaatattcccgtaaggaattcttaggattatgaagacgaaggagaatgtaatatcaaacatgatgcatttgagaattccttgtttatctcttatttcagtcctcaccaggggactcaacagtagatttaagaaaccatttctccttaaactgaggttgtatctattcattccttattcattaccaaggatacaagggcacttctgagttctagatgcaccaaaccctggcatccttctgtttgattttccctcatcgtaggcagtttggagatacaatggggttagggtctgggatggtggttgaatgaaaccttggggcaatagagtagggaagggtctccagccttctctggtgaacatccctcagctcccgtctgtccagcctacagggtcccccttctctgtctgtctccaggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagt

SEQ ID NO: 444554 - DNA, 1773 bp, Homo sapiens
ttactccgttcccactcttggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtatgcgtctgtctctgtgctcactcaaggcctcactgaggcagcggggtgtggtaggttccagtcctggctctggcactagctttcagggtgacatggcgccagtcttataacagctcctaggagaagcgtccacccgtcggtggagc

SEQ ID NO: 444555 - DNA, 1178 bp, Homo sapiens
ttactccgttcccactcttggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaatctgcagaatgtgagatgaggttctcaaggtcacaggccccagtcccagcctgggggctggcagaggcccccatatactctgctacagctcctatcatgaaaaataaaatgtttgtctttgcaaaacagt

SEQ ID NO: 444556 - DNA, 426 bp, Homo sapiens
gagctcggtacccgacgctctctctgtgggggacttcctggggacaaaaggtgactctgtaacatctgctctgtgaagaccctacggggctggggacagggtgctccacccggtggggcggtgtccatctctgactcaaggattgttccagcaatcgagctgctgaggaaggaggagccaggggcttttgtcataagggacagctcttcataccgaggctccttcggcctggccctgaaggtgcaggaggttcccgcgtctgctcagagtcgaccaggtatgcgtctgtctctgtgctcactcaaggcctcactgaggcagcggggtgtggtaggttccagtcctggctctggcactagctttcagggtgacatggcgccagtcttataacagctcctaggagaagcgtccacccgtcggtggagc

SEQ ID NO: 444557 - DNA, 351 bp, Homo sapiens
gtccagggccccgctgcccaccaaggcgtcctgccgactctgggcctgggatcccagagggagcctgtgaacctcaaggggtcagggtgacagaatgagggtagggtggggcatggtggggtggggacgcagctggccagtcctgctgctcctccagggtcctgtggcatggagcgaagcctcattactcggtatcatgttcttttcctacaggtggcagaagtactgcaaaccctcctggtaaggccttcctgtctcagggccccaaacccaacatggggagggaactgcagaaggaaagaggcaccattctgactttaatagtccaaagtgttgatgagggcacaggcc

SEQ ID NO: 444558 - DNA, 631 bp, Homo sapiens
ttactccgttcccactcttggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacattgcgcccatttttcgcaagctattcccactcctagctccatcatgtattcatcaaagccttcgct

SEQ ID NO: 444559 - DNA, 4023 bp, Homo sapiens
ttactccgttcccactcttggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagt

SEQ ID NO: 444560 - DNA, 3257 bp, Homo sapiens
cgtcgttccttacgtcaaaatggacatagagtcaagatagacatgacaatttgtcagagtttcagatagaaaatgaaaaacaagctaagacaagtattggagaagtatgaagatagaaaaatataagccaaaaattggataaatagcactgaaaaaatgaggaaattattggtaaccaatttattttaaaagcccatcaatttaatttctggtggtgcagaagttagaaggtaaaggagatgagctcatctcccttaccgtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagt

SEQ ID NO: 444561 - DNA, 2676 bp, Homo sapiens
gagctcggtacccgacgctctctctgtgggggacttcctggggacaaaaggtgactctgtaacatctgctctgtgaagaccctacggggctggggacagggtgctccacccggtggggcggtgtccatctctgactcaaggattgttccagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagt

SEQ ID NO: 444562 - DNA, 1301 bp, Homo sapiens
ttactccgttcccactcttggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaaggtaggttctgtagcttctaacattgcacacacacacacaggcacacgcacgcatgcaccccctaaaatcactgaaagggaccctgctctgtctgagcaaaatctgggcatgcaccaaaaccagaagcaaatgtttgcttttacagcctttcagatctcaagctgtcctcaagcatttagaatacaattcaatataaaaagtcttgacttatagctaccttttggtaaaagagccgttgccttaatgaggctcatctatatcctttccagccctcatacaacccatctcaaggaaggtttttttaaaccccaaaac

SEQ ID NO: 444563 - DNA, 995 bp, Homo sapiens
tttttatttttttgttgtttgtttgttttggacagcgtctcgctctgtcgccaggctgttgtgcagtggcacaatctcagcttactgcaacctctgcctcccgggttcaagcgattctcctgcctccgcctcccaagtaactgggactacaggcacgcgccaccacgtccagctgatttttgtatttttggtagagacggtgtttcaccatgttggccaggatggtcttgatctcttaacctcgtgatccgccagcctcggcctctcaaagtgctgggattacaggtgtgagccactgagcccggccaattacccactattcttaaaggtcagcagtacttccccaaaggacaggaatgcaccccaaacagaatcttctaatttgcttatttaaaaaaagttttaaatagctcaaactgcaaagacttctaaaacaaagaccacttgtagcatatattaattaatccatgtagcccagagttttgtctagcaaaacccaagttcacacatttgaccacatgcacacgaacctcagccaacgcagccaacgctccccagaggctacttctgcagctaagcatctgtcctttcagctcctggcagttcctgccttttctcttgccaggcaaccagagctctaaagggatcttaatgcactaatgagaagccatgacaaccaagacctgcggtagctgcaaagcacaaacaccagtatccacttttactgagcacgcatgcaataagcaatgtgctaaggaatccaagtaaattaaaatcattcctctaacctaataactccataggcacctataacacaccataacttgaaactttctatcattctttatatttaagaacttattaaaaggcaggctttaccatgcaccactggtagtatagcttgcctcagctgttatagtaactatagaagtagggttattctcttgtttgtttcaatctagagtcataagagaccatcaaaaaaaaaaaaaccc

SEQ ID NO: 444564 - DNA, 684 bp, Homo sapiens
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatcccaaaaaaaaaatcctcgtgtctgacggggaatgttctctggaatccctgcaataaggggaggacccccttaaatgaataaaaaca

SEQ ID NO: 444565 - DNA, 487 bp, Homo sapiens
gacgagctaggagcgaggggatagagccaggggccgcgttaggagcgaaggatggagcccggggcgcagagagggaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccc

SEQ ID NO: 444566 - DNA, 189 bp, Homo sapiens
gacgagctaggagcgaggggatagagccaggggccgcgttaggagcgaaggatggagcccggggcgcagagagggaacccagcaatgaccaggaagatacagtcactaacttcatctgtccccgtgccccttcccaggtcctgcctccacaggtttaacccagaacaataaacctggctttgtcatccc

SEQ ID NO: 444567 - DNA, 942 bp, Homo sapiens
  misc_feature (616)..(616): n is a, c, g, or t
  misc_feature (634)..(634): n is a, c, g, or t
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatcccaaaaaaaaaaaaaaanaaaaaaaacaaaaaaaanaaaaaaaaaaaaaaaaaaaaaaacaaccacgataaacatcaacaaaacaacacaaccagcgggggggggggcggcaaaagaaaacataccaccgacgggagggggccacacaaaactgtagagacacaaagaccagagttagatgaaacaacaaggccgcacaccacaaaagggaggacaatacaataaaccagcagccgcggggcgcggttacaacaagcgcgggggagacgaaaaccaacgctcagggcacatgataagaggaaaaaccaacatgggggggggaaaacaggacgacgacacgaagg

SEQ ID NO: 444568 - DNA, 506 bp, Homo sapiens
  misc_feature (33)..(33): n is a, c, g, or t
gcccgaggattatgaagcactgggcccaagaanaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccc

SEQ ID NO: 444569 - DNA, 912 bp, Homo sapiens
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccctccctcttgcagtcctgtgttcgggtgagcaggccaggtgagcccacaagtctccatgagtgacgtggcctggcgtgctccaccccaccccaccgcctttagcaaccatgtgcccaggggacagctgggcttctacacctctggccctgagcctgagagccgggaaagagtcttttctccatttaaccccgggtgactcactccctggccagtcctcacccctggggacacaaccagagtcaagctggacatcagtaggtcagatgccacctcacaggaccaaggtgccgattaaaccggaatacattcaga

SEQ ID NO: 444570 - DNA, 487 bp, Homo sapiens
ccaggaagagggtgactggtcaggccctctctcagccccaggtcacaatctgactgccccgtgcttctccctcagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccc

SEQ ID NO: 444571 - DNA, 479 bp, Homo sapiens
ctgtaggccaacggtgcacgtgcagaaactcagccaagaatgtttaaagcggctggcaatcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccc

SEQ ID NO: 444572 - DNA, 562 bp, Homo sapiens
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggcctacagcacatgccgtgttgtaggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggacggccccgcttcacttctaatgagaagcttacgctggactacagcacatgc

SEQ ID NO: 444573 - DNA, 600 bp, Homo sapiens
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccc

SEQ ID NO: 444574 - DNA, 759 bp, Homo sapiens
  misc_feature (616)..(616): n is a, c, g, or t
  misc_feature (634)..(634): n is a, c, g, or t
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatcccaaaaaaaaaaaaaaanaaaaaaaacaaaaaaaanaaaaaaaaaaaaaaggggggggcgccaaataaatttccccgggggggccatttttcgttcccccttttttgtcacaagggggccctaaagggggggtataaaagaaggcgggcggtttaaaaagg

SEQ ID NO: 444575 - DNA, 677 bp, Homo sapiens
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtaaggagcggcccggggacttgggggcgaggtggacccccggcttcccggcctcacgtgagcacatctttccccaggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccc

SEQ ID NO: 444576 - DNA, 740 bp, Homo sapiens
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatcccatgacaaaaaacaaataaaaaaaaaatatgtgggcgacacgacaaaaaaagattaagaaccactggtgggccggggcctaggtacggcacgcgcaggggccaaagaaacggcaggcatggggggttcacaaaaaaaccgg

SEQ ID NO: 444577 - DNA, 743 bp, Homo sapiens
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagagacaggtttcactatgctgctcgggctggtcttgaactcctggcctcaaggcatcctcccgcctctgcctcccaaaatgctgggattacaggcgtgagccaccctatggttgtttttaagtgcaacatttatatgtagatggaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccc

SEQ ID NO: 444578 - DNA, 561 bp, Homo sapiens
tcacagtcccgcctccttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaaggtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccc

SEQ ID NO: 444579 - DNA, 419 bp, Homo sapiens
cacacccggccccactttctgttcttgaaagcaggtcacaaggtcccagattcaaggggtggggaaatagatctcacctcttgatgggaagagctacaaaatattgtggccattcttgaaatccgctaccttcccccctccccgcctctgagcccacctactctgtgccaggcaccagggggaccaggactagaggttaagtgaaacacagtccttgatctcagagtatgcactgtctagttggaagagagctacagtacaatagttacaatacagtgtgagaagtgctatcacagaaggacagagaaagtgagattttaatacagaaaccagtcacctgactcttccagcaatatcaagaaagcctttgcagaaaaggtgatgtgcaggctacttcttgaaggatgactaggagtttt

SEQ ID NO: 444580 - DNA, 2577 bp, Homo sapiens
  misc_feature (1)..(1): n is a, c, g, or t
  misc_feature (5)..(5): n is a, c, g, or t
  misc_feature (7)..(8): n is a, c, g, or t
ngcananngcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444581 - DNA, 353 bp, Homo sapiens
gatacgaggtcgagggctgaaccagatgatggcagagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgta

SEQ ID NO: 444582 - DNA, 225 bp, Homo sapiens
tactactactaaattcccggccgcgtcgattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataacaactcgccgcaggtaactctcatccttgtggttatcagtcgacgcgcccgcgaat

SEQ ID NO: 444583 - DNA, 2476 bp, Homo sapiens
  misc_feature (1)..(1): n is a, c, g, or t
  misc_feature (5)..(5): n is a, c, g, or t
  misc_feature (7)..(8): n is a, c, g, or t
ngcananngcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgta

SEQ ID NO: 444584 - DNA, 3230 bp, Homo sapiens
  misc_feature (1)..(1): n is a, c, g, or t
  misc_feature (5)..(5): n is a, c, g, or t
  misc_feature (7)..(8): n is a, c, g, or t
ngcananngcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtgaaaaaaaaaaaaaaaaacaacaaaaaaaaaaaagggggcggccgcgcccaaaattttccccgggggggccccaaactttagcgcgtgttccccgcgctttttttgtccaaagggggcccctatatggggggggccgttttaaaggccaaggccggggcccggttttaaccaccctcttggtgcccgcggcaagcccgttgccttctcttggggctctttggtcacagggacccttcacttcctgctgcggctctggccctcttttctgggcgcaaaccactccccttcccaggaagtttcaacggcctcctagcgctaaacttttataacacttcttccacgcgtgtccttcgtgcttgttcaaccccacacgtggtcctattgtgccttgcggtgctctgggaaacaactttggctccacgcgggacttttgcattttgtggaacactttcttttttccccgcggacacctcttgcttcaacaaaccggtatccaatgccagccgacaacatacacaccaacgatgatgaccacatcaatcacctgccaacactcaacacatcagatacaacacaccacaatcactgatcatacgtgacaattctacacacacatgaacaaccactagacgactcagcactgcccacactgaa

SEQ ID NO: 444585 - DNA, 2206 bp, Homo sapiens
  misc_feature (1)..(1): n is a, c, g, or t
  misc_feature (5)..(5): n is a, c, g, or t
  misc_feature (7)..(8): n is a, c, g, or t
ngcananngcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatccccctcttgttttaggcctcgtttacttttaaaaaatgaaattgttcattgctgggagaagaatgttgtaatttttacttattaaagtcaacttgttaagttttttatgta

SEQ ID NO: 444586 - DNA, 2031 bp, Homo sapiens
agcaagaggaggccgggttgtaatcggcagagtctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444587 - DNA, 1822 bp, Homo sapiens
aaactttgggacattaaaatgggctaagggagatgattgggtagaaagtattattctattcatttgcctcccagcctacaaaaatgcctgcttggggtctaatacttcaacggttaaagatgcctggaagagggcgcggtggctcacgcctgtaatcccagcactttgggaggccgaggcgggtggatcatgaggtcaggagatcgagaccatcctggctaacaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444588 - DNA, 1633 bp, Homo sapiens
aggggaagctccccttgggaggttgatgtataagcgcgaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444589 - DNA, 1328 bp, Homo sapiens
  misc_feature (1)..(1): n is a, c, g, or t
  misc_feature (5)..(5): n is a, c, g, or t
  misc_feature (7)..(8): n is a, c, g, or t
ngcananngcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaattggcatctgctatggggcagatatgctccaggggtctcgaatgggaggctgcggcctccgggctggggtctccccccagggacgtctgggtgggtctgctatgccaccggccttcccggccggtttcccatcccgggtccggggaccccgcgggggtccgcgcagtcttggctgcgggccccccggtgtttctcggg

SEQ ID NO: 444590 - DNA, 1184 bp, Homo sapiens
agataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444591 - DNA, 1009 bp, Homo sapiens
ctacttgtatagctgttcctagaggtatcacctgttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444592 - DNA, 535 bp, Homo sapiens
aaaaaggcttgcttgactgtggacctttaccagatttccttctgggagagtcatagctttgttagtggatggtatctgtgagctttcattctctttctttctaggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgta

SEQ ID NO: 444593 - DNA, 889 bp, Homo sapiens
cggacgcgtgggtcgacccacgcgtcgcccacgcgacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaattggcatctgctatggggcagatatgctccaggggtctcgaatgggaggctgcggcctccgggctggggtctccccccagggacgtctgggtgggtctgctatgccaccggccttcccggccggtttcccatcccgggtccggggaccccgcgggggtccgcgcagtcttggctgcgggccccccggtgtttctcggg

SEQ ID NO: 444594 - DNA, 2494 bp, Homo sapiens
  misc_feature (29)..(29): n is a, c, g, or t
aaggctagtacgaggcggggttaatcggncgaggctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444595 - DNA, 2455 bp, Homo sapiens
  misc_feature (1)..(1): n is a, c, g, or t
  misc_feature (5)..(5): n is a, c, g, or t
  misc_feature (7)..(8): n is a, c, g, or t
ngcananngcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgcgaggagagaagcagcaggggtcctctagagtaacctgc

SEQ ID NO: 444596 - DNA, 2597 bp, Homo sapiens
  misc_feature (29)..(29): n is a, c, g, or t
  misc_feature (241)..(241): n is a, c, g, or t
aaggctagtacgaggcggggttaatcggncgaggctagcagcgcggcctgacgggaccaaggcggcgggagtctgcggtcgttccctcggctgtggaccgggcggcacgcacgcggtgcagggtaacatggcggatgcggaagttatttatgccagaagaaatcatacaggaatgaaacaatggatgccggaaggctcacttcgcgcagagacgaagactgtaggcgcgaacactatcaancatcgtctgtaatgacagtttgcttatcaaaacctgagagtccaaaggttgactaggattggagcacgtctcagtggcgcccttgtggctaaacgcaagttttgactaagcctgaactgctgatgcgacagagcacacgtgatacatccttcgttggccagtggtggtgtccaatagtacacttctggacatggagcagaacgattgggcgagcacgtgattagtcgaggtgaacgatgggcttctccatgtgaactctttggtccaaaaggcgctctgcttaacgccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444597 - DNA, 1981 bp, Homo sapiens
catttcacgagtacccccactttatgaatctgtatgccatatgccggccccgactcgtggaaatgtccacgtggacatttccacgagccaccgtgcctggccagaattacagatctttacagcaaatgcttatattttaagaagtgtgtctgtcacctctagtcttggtggctcagatgaaggataactgcatttctcaaccagtgatgtatttacagtaggtgctgcttttcttttgtgtgtgtgtatcttaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444598 - DNA, 1934 bp, Homo sapiens
ccccacattacctggcactgtggcgaccccccgtagtcccccttctctgggggctttggcccgaggattgcgtgacccccggaaccgggctttccctgggccccggatgggcccccgcccgtccccagtcccccctgggggcacacaaccgggatccctttcccaaaaaaaaaaaaaaaaaaaaaaaaaaagatgcctggaagagccaggactgaagaggctgaagacataatgagcttggactagtaaacaagtgacattcagttttaggaagtttggggtctgatgggctgagatacaaataaactgaattattttcatacatggctgcttttcaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 444599 - DNA, 993 bp, Homo sapiens
  misc_feature (1)..(1): n is a, c, g, or t
  misc_feature (5)..(5): n is a, c, g, or t
  misc_feature (7)..(8): n is a, c, g, or t
ngcananngcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggttggatgggagtgggggcgatgcgactggggcgcggctgggctggggaaggccctggggcgcttgtgttagccagggggttc

SEQ ID NO: 444600 - DNA, 1061 bp, Homo sapiens
tgagatagatagcgtcttgctcttgctcttgctctgcactccagactgggcgacagagcaagactgtgtctcagaaagaaaaaaaaaaaaaacatagattcagttctgttcagtaggtatgcggtactgtcctaggtatctgaatttctgtaaagcttcctgagcaactctgatccagccaggcttatagagcactggtgaagcacatttctcaggcggcctctggagcaggaatcaaaaggattccttgtcagatgtcaggtcctggacttttaggttaaagaaattggtcattttgcctctagtcatactgtgatggggagggtcacaggtgtccagtgcccagaaatgtgagtggaagcagcagcgccttgcgtgtgtgtggtgtagtcatggaccctgcatcccagcttttcttaggccgtgaacgtacctaatttgatggtcgaaacgccagtcggtctgaccgtgtctaggccctgctcctaaggtgtggggagaagggagtcagcagaaatcccactgagctctctgtccccagctgcctcttaggggagccaactggcaggctgaggatctaaggggctggggccttttcctgagcaagcttgagtgcttttgtccagaatagagggtatctgaaatactttgataacaaaaaggcaaaaaaacaaaagtcataaatgcagatttttaaacatcaaatcagactagaagttttaataggaaagctcttgcactgctggacctgactgccacccctcagaggtgaccacttttattactacttttttaatagaaacagggtctcactatgttggccaggctagtcttgaactcctggcctcaagcagttctcctgcctcagcctcccaaagtgctaggatcataggcatttacatcaccaaaagataccactaaaatagctgcccccatttaaaaaaaaaaatcagcctgtcattagcaatgggcttcccattgtggtggatgagatttagctctcaactattttaggagactgtagagatagatatgttacgccagttttttttttttttttg

SEQ ID NO: 444601 - DNA, 2530 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgg

SEQ ID NO: 444602 - DNA, 546 bp, Homo sapiens
  misc_feature (4)..(4): n is a, c, g, or t
aaanactacccctgaggaaagggtggctggtagtagccatggtggtatggttaggcactttttgatttcccatttgtattctattcactaatcataaatcgagtgttgacattgtggacagaatgtaattagctccttttcctgcaaaaatctgtgcttaccctgtttctctctcataggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgg

SEQ ID NO: 444603 - DNA, 3699 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagcatcatggtgctatcttcaaatggttacaggaaggcgatcttgttgggctcagcgttacgtgtatctagagggaacggagctaatggaggaagacagagcagcactgtccactagaaagaggcgagtcacgtacataattttgaaagtttctagcaaccacattagtttaaaaaggtcatgttagcatattatttagctcaaaatatctaaaacatcaacataaggtaaaagtcttcaaaatctggcattttacactttcctcaacactcagtttggactagccacatcataagtgctccgatgccacatggggctatttgcgacagtattggatagcacagccctagaaactgatggaaaaaataagagtaagctaggttggatgacatgtgaattttggtatctagataaggctttcgccatcttttttgtacaacacagtcactaattgtctgaaggtttaaatgacggtctatgctatttccccactccccccaaaataaaacatctaatattttagctatagaatcactaaggcattgatcaaggatgtactttgccaaataagtatttggtaacatcacttaacaagttgatcgtgtattgattctgttaacatatgtgaacctgaaaagtaaagttaccaaaagcgatttggaata

SEQ ID NO: 444604 - DNA, 3573 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagcatcatggtgctatcttcaaatggttacaggaaggcgatcttgttgggctcagcgttacgtgtatctagagggaacggagctaatggaggaagacagagcagcactgtccactagaaagaggcgagtcacgtacataattttgaaagtttctagcaaccacattagtttaaaaaggtcatgttagcatattatttagctcaaaatatctaaaacatcaacataaggtaaaagtcttcaaaatctggcattttacactttcctcaacactcagtttggactagccacatcataagtgctccgatgccacatggggctatttgcgacagtattggatagcacagccctagaaactgatggaaaaaataagagtaagctaggttggatgacatgtgaattttggtatctagataaggctttcgccatcttttttgtacaacacagtcactaattgtctgaaggtttaaatgacggtctatgctatttccccactccccccaaaataaaacatctaatattttagctatagaatcactaaggcattgatcaaggatgtactttgccaaataagtatttggtaacatcacttaacaagttgatcgtgtattgattctgttaacatatgtgaacctgaaaagtaaagttaccaaaagcgatttggaata

SEQ ID NO: 444605 - DNA, 2788 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccaggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444606 - DNA, 2961 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444607 - DNA, 2981 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccagagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444608 - DNA, 2998 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444609 - DNA, 5166 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgcctgtaagtagagccctgcctgccaggggcatggggggtggggggtggggagaaccagctgttgggaggccacgtggggacacgggaggccatgcttggtgagcatctgctctcacgtgggcctaggtgtgacatgggcaagtcagcctctctgaggctctattctcatgaaatgggatcatgttgggttttatgtcacaggactgtggtaggggctaaatacggtgtctgaaggcccggcctattgcctggcctgcagcagggcctagtgaaacagggcccctgcctggtttctcaccctgtcccccaccaagaacacctgtttcctactagctttgccattgtttggaatgatttaacttctaagatcgtttgatcttctttgcaatctgcagatgaagaaactgaggctccaaggaatgaaatgtacgtttaaaggtcactacctaggaggtagtagagctggaatttggacctcagtatagtggcctggagttttgaatcctttctgctcagctaagatgagctgcttccccacagctgcgccacgccccagcttgggcctgggtcctggcggcctccctgtgcatcagaagcaagctgaccagctcagcgctgtgctctcagcacttccagtgccaggccttgagtgtggtattgcaagcctcctgccccttccccctgggctgcttttctgtcactgggaggggccctgacgggggagcagagtgcttgctggggaccgtttccctgcgctgaggatagagagcgccaggtgctgcctgaggcacgcctttcccgtgctccttttccacaaggctctgcccagacctggcagcaaaatggggtgaggtggggctgtggtggtctctaagaaagcattgatgttttcattgccaaggtcaggagcgggcctgcagccttgggtgatgatctgaggccaaggcccatccctgtgtatgaggaatagaaactaggacaggaggccttgtggagcctaggctgtctcaggggatcggccctgctggcaggcagccccctgtgggaggtactggcagagttcggagctcctgcccacccagcacatgggtctgggtctccacaagctcacctttcttcatgagctgggccaggacaggcaggacacctgcctgacattagttgttttgggccgctggagtggacagaggtgaggggtgggacatggccaccctcagacaccctcacccctccttccggaccccctctgtccatgttgctttggggtggggccagcgtctccaggagacaccatggccctaactgtaatgctctccttgccatcctgacaaggagactgtattgtagtcacatccaagacgtaagagacctccgatcccagccacctctgtgttgtacatgagggagctgaggtccagggcaagtgaatagatcgagaacttgacttgaactcctggttctgctgcttattagctgtgtgaccatggacagtgagcaaacctctctgagcttacttttccccatgtactacctccccagtttctaatgctcaaatgcaaatgtgtattggaggcctcacagggcttttactggtagtaaccattattgctacttgtgtgatggaaccaggactggaaactaccatcccagatgccccctcccctgtccccttctctccaggacccaggcctgtgtcacacttgtcctggtctacctttggaccaagtggcctggattgcttgggagtcaggcagtgcctctaacccacactgacatggtacatgtgggaagcagttgaaaagaacccccagggtaccccaagagttatggggaagggggcgcccctccatcagggttggcatcttcaggagggaggactctgggtgttaaagcacagttgagttggtgccaggctgatgggaaacagacgcagcttccccactgtacggaggatatctgcagactcgaagccgggcatttcactgggcccatcacactccccctctcgctgaagccctgtcaggccctggggggtgtgctggcctcctccccatggtgaggtgagaggcacaggtttgtggctgcccaaggccctcagagatggtgagtagcagaagctgggattggaacccatgttcctgcatctgggctggggcagacagggagggatgaggcaagcaaatggatccatggggtagagatggacaagcaactcacccctgggccttggtcagtttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacaacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444610 - DNA, 2768 bp, Homo sapiens
  misc_feature (2650)..(2652): n is a, c, g, or t
  misc_feature (2674)..(2674): n is a, c, g, or t
  misc_feature (2677)..(2677): n is a, c, g, or t
  misc_feature (2684)..(2684): n is a, c, g, or t
  misc_feature (2688)..(2688): n is a, c, g, or t
  misc_feature (2732)..(2732): n is a, c, g, or t
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatggacaaaaaaaaaaaaaaaaaaaaaaaaaaaaaaagcggccgctcgannngtcgacgcggccgcgaattcgngcngcaaacngggnctgcgagaagacgacagaagggaaccaagaaatgtacagatttngaatatggtgactaggcaagggcactttgggctata

SEQ ID NO: 444611 - DNA, 1305 bp, Homo sapiens
gggctgcaggaattggcacgagagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444612 - DNA, 2504 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacaacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgg

SEQ ID NO: 444613 - DNA, 977 bp, Homo sapiens
  misc_feature (4)..(4): n is a, c, g, or t
aaanactacccctgaggaaagggtggctggtagtagccatggtggtatggttaggcactttttgatttcccatttgtattctattcactaatcataaatcgagtgttgacattgtggacagaatgtaattagctccttttcctgcaaaaatctgtgcttaccctgtttctctctcataggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444614 - DNA, 820 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggaaaaggaagcagcacaccaagtaatgggactcttcacaggatgaagcgcaaaaccatgttaaaccctacaaggtgcggttcttccggtccggagtaataccaggccccgccaagtccagttccatccccttgaatctctgcaaaacaaacaccccaaagtacccctgggatccacttgcatatctaatgcccgataggacac

SEQ ID NO: 444615 - DNA, 299 bp, Homo sapiens
agagatggtccacttttctgcaggggctcagggctgctgggggagggcgggggtgggctgtctgcaccctctccccagaccctcacttgggtggctggtgaggagggtccagcctggatcagccctgagcctctgcccctgccatgtccctgcagtgagtacctgatgatgctgatgccacccagccaggaggaggagaagtgagtagaggcggcaggacaccctctccctttccgggctggctgcctctaacccgtcccctctgcttttcccagagacaagcctgtggcccccagcaa

SEQ ID NO: 444616 - DNA, 654 bp, Homo sapiens
ccgggacacagatacatacaagtagctaacataagtttagggacagaattttgtctttaaatatgaagcttatgacagagcaattccattcctaggcagcatctatccaaaagaaatgaaaacatgtgtccacacaaaaccatacacagttgttcacagtagcatcttcatgatagccaaaaagtggaaacaacccagatgcccatccgctggattcatggagaaacagaatgtggtccattcacgcaatgggatgttatttgaccatggaaaagaatgaagcagtgatgctaccacgcagatgagccttgagaacattgtgctaagtgaaagaagccacatgcttcttcactcgcagctacgcgctgtgtgattacgtctcagtcagcgaccgaccacatactcaacggtggtcccataacattataatggagctgaagaattggcttacctagtgatgtcttaatgagcctgaccctgtgtaagcctaggctaactcgtatgtttgtgtcttaggtttttgcttgttcgtttgttttgttttgttttgagacagagtctcgctctgttgcctaggctggagtgcagtggcacagtctcggctcactgcaacctctgcctcctgggttcaagcgattctcctgcctcagcctc

SEQ ID NO: 444617 - DNA, 5829 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgcctgtaagtagagccctgcctgccaggggcatggggggtggggggtggggagaaccagctgttgggaggccacgtggggacacgggaggccatgcttggtgagcatctgctctcacgtgggcctaggtgtgacatgggcaagtcagcctctctgaggctctattctcatgaaatgggatcatgttgggttttatgtcacaggactgtggtaggggctaaatacggtgtctgaaggcccggcctattgcctggcctgcagcagggcctagtgaaacagggcccctgcctggtttctcaccctgtcccccaccaagaacacctgtttcctactagctttgccattgtttggaatgatttaacttctaagatcgtttgatcttctttgcaatctgcagatgaagaaactgaggctccaaggaatgaaatgtacgtttaaaggtcactacctaggaggtagtagagctggaatttggacctcagtatagtggcctggagttttgaatcctttctgctcagctaagatgagctgcttccccacagctgcgccacgccccagcttgggcctgggtcctggcggcctccctgtgcatcagaagcaagctgaccagctcagcgctgtgctctcagcacttccagtgccaggccttgagtgtggtattgcaagcctcctgccccttccccctgggctgcttttctgtcactgggaggggccctgacgggggagcagagtgcttgctggggaccgtttccctgcgctgaggatagagagcgccaggtgctgcctgaggcacgcctttcccgtgctccttttccacaaggctctgcccagacctggcagcaaaatggggtgaggtggggctgtggtggtctctaagaaagcattgatgttttcattgccaaggtcaggagcgggcctgcagccttgggtgatgatctgaggccaaggcccatccctgtgtatgaggaatagaaactaggacaggaggccttgtggagcctaggctgtctcaggggatcggccctgctggcaggcagccccctgtgggaggtactggcagagttcggagctcctgcccacccagcacatgggtctgggtctccacaagctcacctttcttcatgagctgggccaggacaggcaggacacctgcctgacattagttgttttgggccgctggagtggacagaggtgaggggtgggacatggccaccctcagacaccctcacccctccttccggaccccctctgtccatgttgctttggggtggggccagcgtctccaggagacaccatggccctaactgtaatgctctccttgccatcctgacaaggagactgtattgtagtcacatccaagacgtaagagacctccgatcccagccacctctgtgttgtacatgagggagctgaggtccagggcaagtgaatagatcgagaacttgacttgaactcctggttctgctgcttattagctgtgtgaccatggacagtgagcaaacctctctgagcttacttttccccatgtactacctccccagtttctaatgctcaaatgcaaatgtgtattggaggcctcacagggcttttactggtagtaaccattattgctacttgtgtgatggaaccaggactggaaactaccatcccagatgccccctcccctgtccccttctctccaggacccaggcctgtgtcacacttgtcctggtctacctttggaccaagtggcctggattgcttgggagtcaggcagtgcctctaacccacactgacatggtacatgtgggaagcagttgaaaagaacccccagggtaccccaagagttatggggaagggggcgcccctccatcagggttggcatcttcaggagggaggactctgggtgttaaagcacagttgagttggtgccaggctgatgggaaacagacgcagcttccccactgtacggaggatatctgcagactcgaagccgggcatttcactgggcccatcacactccccctctcgctgaagccctgtcaggccctggggggtgtgctggcctcctccccatggtgaggtgagaggcacaggtttgtggctgcccaaggccctcagagatggtgagtagcagaagctgggattggaacccatgttcctgcatctgggctggggcagacagggagggatgaggcaagcaaatggatccatggggtagagatggacaagcaactcacccctgggccttggtcagtttcccccccagactgctgcttccccggatgagcagaaggtgtttgccctctgggagtctggagacatgagtgatcaggtgaggtgaactttgctgccatcttcccgaagagccaggggggtttcctgcagcgttggaggccttgggggacatgtgcacccaaagtgcagccacacatttcagattttctggcacactcggttttaaatatcctgctccaactctgtacgctaacaaaataagctgtatgtgccaatagtttgaacctaaaccagtggttcccagatgccagtctgtgagccagctccatcagaatcatcttttaaaaaatacaggctgggcgtagtggctcacgcctgtaatcccagcactttgggaggccaaggtgggtggatcacctggggttgggagtttgacaccagcctgaccaatatggtgaaaccccatctctactaaaaatgcccatagtcgtgggaggctgagacagaattgcttgaacctgggagagagaggttgcagtgagccgagattgcaccactgcactccagactgggcgacagagcaagactgtgtctcagaaagaaaaaaaaaaaaaacatagattcagttctgttcagtaggtatgcggtactgtcctaggtatctgaatttctgtaaagcttcctgagcaactctgatccagccaggcttatagagcactggtgaagcacatttctcaggcggcctctggagcaggaatcaaaaggattccttgtcagatgtcaggtcctggacttttaggttaaagaaattggtcattttgcctctagtcatactgtgatggggagggtcacaggtgtccagtgcccagaaatgtgagtggaagcagcagcgccttgcgtgtgtgtggtgtagtcatggaccctgcatcccagcttttcttaggccgtgaacgtacctaatttgatggtcgaaacgccagtcggtctgaccgtgtctaggccctgctcctaaggtgtggggagaagggagtcagcagaaatcccactgagctctctgtccccagctgcctcttaggggagccaactggcaggctgaggatctaaggggctggggccttttcctgagcaagcttgagtgcttttgtccagaatagagggtatctgaaatactttgataacaaaaaggcaaaaaaacaaaagtcataaatgcagatttttaaacatcaaatcagactagaagttttaataggaaagctcttgcactgctggacctgactgccacccctcagaggtgaccacttttattactacttttttaatagaaacagggtctcactatgttggccaggctagtcttgaactcctggcctcaagcagttctcctgcctcagcctcccaaagtgctaggatcataggcatttacatcaccaaaagataccactaaaatagctgcccccatttaaaaaaaaaaatcagcctgtcattagcaatgggcttcccattgtggtggatgagatttagctctcaactattttaggagactgtagagatagatatgttacgccagttttttttttttttttg

SEQ ID NO: 444618 - DNA, 3035 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444619 - DNA, 5266 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgcctgtaagtagagccctgcctgccaggggcatggggggtggggggtggggagaaccagctgttgggaggccacgtggggacacgggaggccatgcttggtgagcatctgctctcacgtgggcctaggtgtgacatgggcaagtcagcctctctgaggctctattctcatgaaatgggatcatgttgggttttatgtcacaggactgtggtaggggctaaatacggtgtctgaaggcccggcctattgcctggcctgcagcagggcctagtgaaacagggcccctgcctggtttctcaccctgtcccccaccaagaacacctgtttcctactagctttgccattgtttggaatgatttaacttctaagatcgtttgatcttctttgcaatctgcagatgaagaaactgaggctccaaggaatgaaatgtacgtttaaaggtcactacctaggaggtagtagagctggaatttggacctcagtatagtggcctggagttttgaatcctttctgctcagctaagatgagctgcttccccacagctgcgccacgccccagcttgggcctgggtcctggcggcctccctgtgcatcagaagcaagctgaccagctcagcgctgtgctctcagcacttccagtgccaggccttgagtgtggtattgcaagcctcctgccccttccccctgggctgcttttctgtcactgggaggggccctgacgggggagcagagtgcttgctggggaccgtttccctgcgctgaggatagagagcgccaggtgctgcctgaggcacgcctttcccgtgctccttttccacaaggctctgcccagacctggcagcaaaatggggtgaggtggggctgtggtggtctctaagaaagcattgatgttttcattgccaaggtcaggagcgggcctgcagccttgggtgatgatctgaggccaaggcccatccctgtgtatgaggaatagaaactaggacaggaggccttgtggagcctaggctgtctcaggggatcggccctgctggcaggcagccccctgtgggaggtactggcagagttcggagctcctgcccacccagcacatgggtctgggtctccacaagctcacctttcttcatgagctgggccaggacaggcaggacacctgcctgacattagttgttttgggccgctggagtggacagaggtgaggggtgggacatggccaccctcagacaccctcacccctccttccggaccccctctgtccatgttgctttggggtggggccagcgtctccaggagacaccatggccctaactgtaatgctctccttgccatcctgacaaggagactgtattgtagtcacatccaagacgtaagagacctccgatcccagccacctctgtgttgtacatgagggagctgaggtccagggcaagtgaatagatcgagaacttgacttgaactcctggttctgctgcttattagctgtgtgaccatggacagtgagcaaacctctctgagcttacttttccccatgtactacctccccagtttctaatgctcaaatgcaaatgtgtattggaggcctcacagggcttttactggtagtaaccattattgctacttgtgtgatggaaccaggactggaaactaccatcccagatgccccctcccctgtccccttctctccaggacccaggcctgtgtcacacttgtcctggtctacctttggaccaagtggcctggattgcttgggagtcaggcagtgcctctaacccacactgacatggtacatgtgggaagcagttgaaaagaacccccagggtaccccaagagttatggggaagggggcgcccctccatcagggttggcatcttcaggagggaggactctgggtgttaaagcacagttgagttggtgccaggctgatgggaaacagacgcagcttccccactgtacggaggatatctgcagactcgaagccgggcatttcactgggcccatcacactccccctctcgctgaagccctgtcaggccctggggggtgtgctggcctcctccccatggtgaggtgagaggcacaggtttgtggctgcccaaggccctcagagatggtgagtagcagaagctgggattggaacccatgttcctgcatctgggctggggcagacagggagggatgaggcaagcaaatggatccatggggtagagatggacaagcaactcacccctgggccttggtcagtttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444620 - DNA, 2834 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaactggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444621 - DNA, 2820 bp, Homo sapiens
ggccaagatcaagcccaagcagcagaaggtcatcgaggctgggaggtgcggaatgtcatcgtaggtcatcgaggctggacgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444622 - DNA, 2626 bp, Homo sapiens
  misc_feature (93)..(93): n is a, c, g, or t
  misc_feature (97)..(98): n is a, c, g, or t
agagatatgtactagtacgtcaccggttttatttcagtacgcgggacgcagagctttacatgttcttcacatgagccagctagttcacacatnccgnnatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444623 - DNA, 1707 bp, Homo sapiens
  misc_feature (45)..(45): n is a, c, g, or t
caccgtcccgcgctgccccaccaatacgggctaggtagcgaggcntcggtgttgggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaacta

SEQ ID NO: 444624 - DNA, 2605 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcacagggtcagcttaagttagttagatcactcccagaagagaccagctgggaccttcttttggtgggccaattcgaaaattccttgtgtagtttttgcttaagcttttggggtttggtcttcatttcttaataaataatggta

SEQ ID NO: 444625 - DNA, 1563 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggctgccggctggtctgtgggacacgatccattaccaaaccaggccac

SEQ ID NO: 444626 - DNA, 628 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggcagcatctatccaaaagaaatgaaaacatgtgtccacacaaaaccatacacagttgttcacagtagcatcttcatgatagccaaaaagtggaaaca

SEQ ID NO: 444627 - DNA, 564 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgc

SEQ ID NO: 444628 - DNA, 652 bp, Homo sapiens
cgagagaacaagaccttgtcttggaaaaaaaaaaagaattgtagaccatttgcttgtgttctttctccggggatcagatctcaccctctttctgccgtacttcctcatctcctacgtgtggatgatgatattgtgccctgtgcatgttcttcgtcaccaaaagtgcctctctcatagagcaggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgc

SEQ ID NO: 444629 - DNA, 506 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagcaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgc

SEQ ID NO: 444630 - DNA, 705 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagcaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcaaaaaaatgacactctcacctagaattcttcacaacttctctatttacctattctcgcgaattgaaacaaaaacactttagggggggccctcggtaccccaattctcctctataggggagtcggattacaattccactggcccggtgttttacaacggtggagactgcgaccctgggtgttaccccttcgcctttggag

SEQ ID NO: 444631 - DNA, 956 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaaggtgccaagatggaggggctgactcagtccagccaacatttaatgagcacctactttatgtatggagctctaacccatgggtccatgggaataaagcagtgaatagtaacaataaataatcgtaacagcaaaaaaaaaaaaaccgaaaaaacacctttttgggccgcgtcatgggactcttgaaagaaggtttttgaaacccatgtcgttagggcacgggcgccccaagtgagtgtaatacgacacggtgccacgacggcggttccccagaggaaactcgtgcccagaacaaggccgtgcgattttccccaatataaaagcgccgggggaaacccggcgtgtttggaactacccgcg

SEQ ID NO: 444632 - DNA, 677 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaatcaaggtgccaagatggaggggctgactcagtccagccaacatttaatgagcacctactttatgtatggagctctaacccatgggtccatgggaataaagcagtgaatagtaacaataaataatcgtaacagcaa

SEQ ID NO: 444633 - DNA, 502 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgc

SEQ ID NO: 444634 - DNA, 266 bp, Homo sapiens
cgagagaacaagaccttgtcttggaaaaaaaaaaagaattgtagaccatttgcttgtgttctttctccggggatcagatctcaccctctttctgccgtacttcctcatctcctacgtgtggatgatgatattgtgccctgtgcatgttcttcgtcaccaaaagtgcctctctcatagagcaggtgagaactcagtgaggagatgcagggacatgaggtctgacttagggcagagccctaaggtaacacatttgatctactgtaggt

SEQ ID NO: 444635 - DNA, 495 bp, Homo sapiens
acatgacaccccctcaatgttccaggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgc

SEQ ID NO: 444636 - DNA, 672 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagcaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaaggtgccaagatggaggggctgactcagtccagccaacatttaatgagcacctactttatgtatggagctctaacccatgggtccatgggaataaagcagtgaatagtaacaataaataatcgtaacagcaa

SEQ ID NO: 444637 - DNA, 503 bp, Homo sapiens
acccaggagtccaggtccccagaccctcctccctcagacccaggagtccaggcccccagcccctcctccctctaaccatctgtgctttctccccaggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaaggtgccaagatggaggggctgactcagtccagccaacatttaatgagcacctactttatgtatggagctctaacccatgggtccatgggaataaagcagtgaatagtaacaataaataatcgtaacagcaa

SEQ ID NO: 444638 - DNA, 593 bp, Homo sapiens
gactgacagagactgagatatagacactatgagcgcgcgactcctaccaactatggatcttgacctcctgatattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagcaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaaggtgccaagatggaggggctgactcagtccagccaacatttaatgagcacctactttatgtatggagctctaacccatgggtccatgggaataaagcagtgaatagtaacaataaataatcgtaacagcaa

SEQ ID NO: 444639 - DNA, 430 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagtagcacctgcccctggagaaatggggtctggcccataccaccgactgcatccaggacccagaagttcaggccccagcccctcctccctcagacccaggagtccaggcc

SEQ ID NO: 444640 - DNA, 543 bp, Homo sapiens
  misc_feature (15)..(15): n is a, c, g, or t
tccgattaatacgcncactttggggatttggctcgagccaagattcggcacgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgc

SEQ ID NO: 444641 - DNA, 667 bp, Homo sapiens
  misc_feature (15)..(15): n is a, c, g, or t
  misc_feature (563)..(564): n is a, c, g, or t
  misc_feature (568)..(568): n is a, c, g, or t
tccgattaatacgcncactttggggatttggctcgagccaagattcggcacgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcaaaacaaatgaaaagacctnnctgnagaccgctctggggatgagaacttgagaactggtaaggccttccaggtcactggcaaccatggggaaaaaaacattcacttggccgccttttacaacgc

SEQ ID NO: 444642 - DNA, 596 bp, Homo sapiens
cgagagaacaagaccttgtcttggaaaaaaaaaaagaattgtagaccatttgcttgtgttctttctccggggatcagatctcaccctctttctgccgtacttcctcatctcctacgtgtggatgatgatattgtgccctgtgcatgttcttcgtcaccaaaagtgcctctctcatagagcaggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacaggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgc

SEQ ID NO: 444643 - DNA, 730 bp, Homo sapiens
gggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaaggtgccaagatggaggggctgactcagtccagccaacatttaatgagcacctactttatgtatggagctctaacccatgggtccatgggaataaagcagtgaatagtaacaataaataatcgtaacagcaa

SEQ ID NO: 444644 - DNA, 219 bp, Homo sapiens
aaactaaataacattgtgttaaataaggagaaatgcctttaggcaaaagcaaattaagtacacctgctggatctgtagggaagatacaataaagcagtaaatgtctgtgaaaaatatgaaacagaaatctaagcttgcatgttttagattaagaaaatattagtgtagttttttatctaccaaatattttactaagagttaaagtaatactttataaag

SEQ ID NO: 444645 - DNA, 6799 bp, Homo sapiens
  misc_feature (3190)..(3190): n is a, c, g, or t
  misc_feature (3709)..(3709): n is a, c, g, or t
ttcccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtaaaagtctgttatatctataaaagtataatctgaataaactagaaggaagagaactatttcatttttaagcacttttttaaactcacttaaaatacctttgctttatttgtatacttttctcccccttcttacaaaagtgacatttgctgtaaatactgagtataaagaaaaatgttacccataatcctagccctcagatacaacctgtaactaaacatttttggtataccactaccatatacctcatgtgcacattggctgccttaataaaatacaacagactgggtagcttaaacaacagaaaataattttctcacaggtatgaaggctgggaagtccaagatcaaggtgtccactgactcagttctggaggagggctcccttcctagatggagactgctgccttctcaccgggtcctcacatgatagagggagaaagagtgtgctctggtgtcttttcttataagggcaccagccttgtcagagtaggaccccactctatgacctcatttaacctttaccacctcctcacaggccctgtttccaattatagtcacgttgggggttagggcttcaacatatgattttgagacataagcttgcatttcataacacgtgtctatgcagatttgcacatgcatgtgtgtataagtttgtcagtaggaaccacagtgtatactttcttgttactggcttttttctctaaatcaggtataccgaacatgatttttctttaagatcatatttttaattttcacatagttatctcttatgccatccagtgtagttttcttaaccaatacctagctatagattatattagtggttttaatttgtttgaaattagggataatattacgataggcattttttaaatgtaatccattttatacatctaatttcttggataatcttttagaaataaaattaggctgtaaatatttgacagacaccaaaatatattttctagaaatttattaccaaaaattaataaacataccggtttactaaaccctgtccaacactggatattattttcttttaaaaactaagtaccaatttggtagttttatattatgattgttttaaatacactagtattattgaagttggacattttttgaccatttttgttttttacattatgaatcgactcctaatggtgtcggctgatttttctattgtttttgttatgtactctaaatatttgcttgatttagttttttaaaaataattctaaaattttaattttatgtagttatgactgttaatttttttttatgaagcaagccatggattatatacttagaagggctttctctttggctcttctttctacaaaaaattgtcttgtataatattttctcctagtttttatatggttttgtctagttctttgcatgcttcagtttcttcacatttaagacttagtctatcagcagattattgtgtctaacagtatgagttgccagtctgatttttaaaaattttaacaatttgttagctgttccactatcacccgataaacatttttcagtacaaatgatagaaaagcatatcctgtatcctgacaacaaaagtagattacttgcaaaagaacaaaatcagactgaacctagagttttcctctgtaacactaaaaaactagaaggtgatggaatatgtctgtagagctttcagggaaaaattaagagcccccaaaaacttgatattcagagaagttatttctctgcataggaccatgtaaatatattttcactcatgcagagaatcagaagatatgccatctagttaatcctgtctgaaaaattattcaatccactgagaacttcagtgaactcaagaattagcaagttatgccctaaagtgctggtgatgaagagcaaaagaaaaatgagaaaggacataaaatagataagtttagaagtttcaaggaaggagactattaattgcaaaaatatanatgacctaatgtgacccaagaagtaaaaactttcagtaagtaaataatcaagaaaggaacttaaaatttttacaataagaactacccagaaagatgactccttcatccgggtgatttatatgtcaagttcttccagacttctgaagggcagataattcctgtgcatttcttcccacccttgccccaccctgcccaaaagagtatttcaggaaaaaattattataccttgattctcaatgtaattgtatattcagtgtatttccctttattttccagcagtatcatacataaacagttaattggtatctaggtgtttgttacatagtcataataaagacatttaattttttttaactaggtatcttatggtgagatggtgggatgtgataaccaagatgtaagtattacatttttctatttaggaatgaaaaaaatcacaggttgttattacttgaatatttgtcttatttgctgtatggtttggtctaagaaaacaggtttgcaggtatattagttatnttatgctaatgctagaatattcctcttcaaaatagggtagtgtcccttaatgtgttccctattttaatttttaaagctaattttatggttttatgtgcagattgtctcagaagtgttatgttgtatgaaaattataaataccctcctttccctttactaaaaaatactgtgtttactagaatccagttcatttatcacattgaagaaatggaattttaaaacaattcattctttcaggctgcaccgtgctaaagtgaagggtgggataattgaggatctaatgtgagattatcttcctctcatgagtataatattttttcctgtactctgcaggtgtcagctgataagagccacccctgatctaaaaagtaaaggaaatttgaaaggaaggaattcttggtttttaggagacttaattttagttagagatacgttttttattcaatactgagaatattgttgtctagtaattttgactccctccttatttagtagtgacaggatcctaagattaacaagagttttaaatttgtaaaacaatctgaagattgagggagctggctaggtgcattaaaatgtgtacttttcctagacctgatagggttacagcaacatgctcacgtagattgggacagagcctccttctgtttccctgtctagaatcccttgtaggctgtttgtggttgttgcaaaaacaatattgcccaaccatttcaagaacatcactgtaaactcttctggggcagttagtgaaaatgatgaatgaggtttctatggagtacccagcatcatgcttctctggattcttcttattccccagttgtgctcttctgagtgctaaggactttcatgaaagagttttctgcttaatatgtttcaaagaggaataatttttctctacatttcaaggaatagaaacacccacgtaggaaatgcagggcataagacataaattaatgtctttaattacaatcagcttattctactttatgagacagcaaataaggctgactattaaataaaatcttaagttatatttaccttctacatagaagattcatcccacttctttttgcccttgaaagctgaaaactagtgaattttcattcattaggatgaggggactagattacatggacctcaggattcttgaagatgcataatttttctgtgccttcatttcctcattcctgaagcttatcatttagtctaaatgatgtctaaataatctagatctaaaaattctgatgtcacacatctaattattgttaaattaaatggattattcagtctcctgagcatattttaatatactctcttgtcttcagaagtactgaaaacttgttttttgcaattttgctttctagtgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444646 - DNA, 2889 bp, Homo sapiens
ttcccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444647 - DNA, 2204 bp, Homo sapiens
  misc_feature (42)..(42): n is a, c, g, or t
tttttctagttcctcgtccaccctttttgttttttttatttnccctttttctactatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444648 - DNA, 804 bp, Homo sapiens
ttcccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtaagtaaaagtaatgtgcatactgtgccataagtacttgaataacagattatatcttaaattgtattggcttaaatgtagtaggaagaagcaactaaaactgaagtattgctctcttgatcacatctaatttgacatttcagtgtccattttatggtttctttgtggaaaagtcagagtggttagttaatgtggtgagaactgtacattttagcaagtctatacggcggtaaggtggtttctgatgttagatattttttaaacaagaattaatgtttaactttattttactaatccttgtcttcttaaggtagtgtgtttacttgccttatacatcattttgagattgtttctgtggtaaaatacacctaagaagactgctttgacaagagttcttggtagtctgattaaaat

SEQ ID NO: 444649 - DNA, 2889 bp, Homo sapiens
ccggagtcgagcgggtgctgctagcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444650 - DNA, 2914 bp, Homo sapiens
ttcccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444651 - DNA, 2986 bp, Homo sapiens
ttcccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444652 - DNA, 1819 bp, Homo sapiens
  misc_feature (47)..(47): n is a, c, g, or t
  misc_feature (91)..(91): n is a, c, g, or t
gttccgactacaccttactgactactacatcgacattcaacccacancctccagtgacaactagcgggcggagttttgggatgtgataacnaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444653 - DNA, 3002 bp, Homo sapiens
aaaccgttaaatacttggaaacgctaccgattaagtggggggccggccccatgcgcgggatacgaacgacgagcgcagcgagtagtgagcgagagcggcgataacttcgtatactacatatcgaagtatagtcgaggacgaattccggaatcggcatacgcggggcctgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444654 - DNA, 2462 bp, Homo sapiens
gtttaaaaacacatgaattttttatttatatttagaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctcccta

SEQ ID NO: 444655 - DNA, 1201 bp, Homo sapiens
ttcccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttgcagcacttctaaaagattgaaaacaccaagaagatagatagaatattcactatttctcatattgatgcaattgtggtgctctttttcatttgaaacatcttctcctaaaatatacactttaagaaatagtcatttctgtttttgcattaaagtaaattaaagcagaaaacacatgctcacttttggctaacttcagtgtatagatttcatacttatgttgtctttcctgggtacagatttattactgaacaagtacgtgtaagtaaaatgtcattggtgagcaggacacaagataaaaggtgaacaccacatatggtgtgaattgtaaatgcttataccacaaacttgaaaatgtgtcatgtagagccatggaaaatgtctagttgtttttatgtagtacacacattttaatggtgctaacaacctgggctcttttgttcatagagttattctgaaaaaaatttcataaaagacactgcctaaagataggtagaataggctgtagcttgatttactgtggaataaaaaccaaaaaaaaaaaggtcttaattgtttcagtctttaattatgtctataaacttagaaaaaggcatttacatttgaatctagactaatttgtttagtaacattcttcctcatattcaatgactgtatgtatcagtccttatttagagactgcctgctttttaattcatatagctctttggttctattctttgttttgtttattattttgttgttttattgcttgttagacctttactaaagatattttgtgtatttagaaaaaatataacataaatatatgctt

SEQ ID NO: 444656 - DNA, 585 bp, Homo sapiens
  misc_feature (27)..(27): n is a, c, g, or t
cggacgcgtgggtcgacccacgcgtcngttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444657 - DNA, 595 bp, Homo sapiens
aaaataatgtgtaaaatatttgtgctatctgtataagatgtatatgaaaccccaaagaattttgacttgggtcccatccccaagatatctcattatgtatatgcaaatatccccaaatctgaaaaaaaaaaaaaaaaaaaaactcgagactagttctctcctcgtgccgcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444658 - DNA, 2553 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatcttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444659 - DNA, 2229 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444660 - DNA, 1074 bp, Homo sapiens
tatttctcgatcgagaacctagcatgtctcgaatcgttaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444661 - DNA, 1088 bp, Homo sapiens
  misc_feature (27)..(27): n is a, c, g, or t
cggacgcgtgggtcgacccacgcgtcngcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444662 - DNA, 3116 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaaaaaaaaaaaacaaaaaacacaaaacaaagaaaaagacactaaacaatagcaacaacacgaaacatcgcaaccacacacaatatatcacgcacacgcagagccgactccaaatgccacaacaatacagcgcggcacgacgatcaagacataaaataagacatcagacaggggggcccaccgaacaatgactgactgcacgcctatgctatatgacaacaggagggcgcctgcctgcgtcttagagacgattacgtataacgacggaagccggacgcgacgacgcgatgttatacgaccagcggagatcgaggggaatgaagacctaggctgcaggagagcgtgtgctagagggaccacacccctatctgaggggccgacagtcagattgagaccaagcgaacagagaagagtaaggacgcggtagataaaccatatagggaggatggcggtgaacagcgctctacttcgggccgaagacagtcgggagggatcgtagtgaaaata

SEQ ID NO: 444663 - DNA, 2488 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggagaccacggtgcagtaccaagggcacatgctgtcagctcgagactacaggatccgcggtgaggggaagaagcgcgataagacgtgaaccagcgacgcattagagcccgacacgcaacgcaacgcaggatccccagtctgcctaggg

SEQ ID NO: 444664 - DNA, 916 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcaggttgccccagaacattgaaagactacaccgtccttatggggtggctctgactgtgcagcctggtggagggagaggaaaaagcacctatcaaagtcttctggaaaataggcattgagtcattcttttgccttaagtctttctcatttattttgcaaaggactttcactgtataagtttggcatctgggagttaatcattacaacttaatttcccttgtaagtctggaggctccttcgaattgggttagcttcccctccccctactctatcacttggcagccttgtgaccttggctgagaagctttcgaacttgatgagcctcagtttccttatctgtaaaatgggtacagtgataccttctggggttgatataatgagtccatgaaaaataaaatatgaaataactttgcacactataaagggctattccg

SEQ ID NO: 444665 - DNA, 2612 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444666 - DNA, 1884 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444667 - DNA, 2542 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtcctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtacttctaaa

SEQ ID NO: 444668 - DNA, 2417 bp, Homo sapiens
cactcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggacgcagctgctctgagcaactccattcacccctattatgtcctgaagctacgctaagagccacgacaatgaaccgattgagatttcaaactctggcagctacattatgctgcatacggaccattgtatgtctctagataatggacaagttgg

SEQ ID NO: 444669 - DNA, 2123 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaaggtgtcccaaggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccgcatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggacgaagatgccctacatggaggcagtgatccacgagatccaaagatttggagacgtgatccccatgagtttggcccgcagggttaaaaaggacaccaagttttgggattttttcctccctaagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgctacaccatgcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 444670 - DNA, 632 bp, Homo sapiens
ggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctactttgaccaccctcggctttggcttctgctgctaa

SEQ ID NO: 444671 - DNA, 2301 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggatgcttctggtggccttgctggtctgcctgactgtgatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctcttatttcctcgcaaaaaaaaaaaaggaattc

SEQ ID NO: 444672 - DNA, 2855 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggatgcttctggtggccttgctggtctgcctgactgtgatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagatccgcccccaccccccagactacggggacttccagcccctctctgtgtccccagcatcccacccacattagaagctttctagaccctgtcccactccctcaatcagtcaaagtcctgcatctctccagactctttgtgtcaggagaatcaaacacatgttcccaaacttcctatcttaagaaacagaagccccctttccattcggccttttgtcatagggacagaaatctcaggtcccccaaactcctgcctagaaggacatggaccccatgtctcccaaacttcctgtttcagagatgtgaaccttctatcccccaaagctcctccatcagaggaccccaactcctccatgcctgccacttccccttacctggggcacactagttccccctccagcccctgtgtactttcaccaatcccccgaccctcctcatcacacacaacttcctcctcccggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcgcctggtatttctccagcttggaagttcctgttagaatctacccttgagccagcagctgatacttccttaactaccaagcacccagtacctgcgcccaggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctcttatttcctcgcaaaaaaaaaaaaggaattc

SEQ ID NO: 444673 - DNA, 1615 bp, Homo sapiens
aaagatcatcaatcccatggtctaagcatatcgcattagtactatcagtgatcaacataatgtcctgtctctgttcaccgtgggtctctgaatcatccagtgcactctcctacaccagagccgtgacctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccgcatgcaggaggcaccgagacggtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagatccgcccccaccccccagactacggggacttccagcccctctctgtgtccccagcatcccacccacattagaagctttctagaccctgtcccactccctcaatcagtcaaagtcctgcatctctccagactctttgtgtcaggagaatcaaacacatgttcccaaacttcctatcttaagaaacagaagccccctttccattcggccttttgtcatagggacagaaatctcaggtcccccaaactcctgcctagaaggacatggaccccatgtctcccaaacttcctgtttcagagatgtgaaccttctatcccccaaagctcctccatcagaggaccccaactcctccatgcctgccacttccccttacctggggcacactagttccccctccagcccctgtgtactttcaccaatcccccgaccctcctcatcacacacaacttcctcctcccggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctcttatttcctcgcaaaaaaaaaaaaggaattc

SEQ ID NO: 444674 - DNA, 1674 bp, Homo sapiens
aaagatcatcaatcccatggtctaagcatatcgcattagtactatcagtgatcaacataatgtcctgtctctgttcaccgtgggtctctgaatcatccagtgcactctcctacaccagagccgtgacctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccgcatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggacgaagatgccctacatggaggcagtgatccacgagatccaaagatttggagacgtgatccccatgagtttggcccgcagggttaaaaaggacaccaagttttgggattttttcctccctaaggtgctatcctccccaccccctagactacggggacttccagcccttctctgtgtccccagaatcctgcccccattagaagctttctactcactgtcccactccctcaatcagtcaaaaaggacttccccaaccaccacatccattccacctttccacttagacactcctgagtcctgcatctccccagactctttgtgtcgggagaatcaaactcaagttccaaggacacaaatttcaggtcccccaaacaacctgcgtagcaagacatggaccccatgtctcccaaacttcctgtttcagagatgtgaaccttctattccccaaagctcctccttcacaggaccccaactcctccatgcctgccacttccccttatctggggcaccccagttccctctccagcccctgtgtactttcaccaatcccccgaccctcctcatcacacacaacttcctcctccctaccagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgctacaccatgcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 444675 - DNA, 1577 bp, Homo sapiens
aaagatcatcaatcccatggtctaagcatatcgcattagtactatcagtgatcaacataatgtcctgtctctgttcaccgtgggtctctgaatcatccagtgcactctcctacaccagagccgtgacctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccgcatgcaggaggcaccgagacggtcagcaccaccctgcgctatggcttcttgctgctcatgaagcacccagaggtggaggccaaggtccatgaggagattgacagagtgatcggcaagaaccggcagcccaagtttgaggaccggacgaagatgccctacatggaggcagtgatccacgagatccaaagatttggagacgtgatccccatgagtttggcccgcagggttaatccgcccccaccccccagactacggggacttccagcccctctctgtgtccccagcatcccacccacattagaagctttctagaccctgtcccactccctcaatcagtcaaagtcctgcatctctccagactctttgtgtcaggagaatcaaacacatgttcccaaacttcctatcttaagaaacagaagccccctttccattcggccttttgtcatagggacagaaatctcaggtcccccaaactcctgcctagaaggacatggaccccatgtctcccaaacttcctgtttcagagatgtgaaccttctatcccccaaagctcctccatcagaggaccccaactcctccatgcctgccacttccccttacctggggcacactagttccccctccagcccctgtgtactttcaccaatcccccgaccctcctcatcacacacaacttcctcctcccggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctcttatttcctcgcaaaaaaaaaaaaggaattc

SEQ ID NO: 444676 - DNA, 478 bp, Homo sapiens
cttttgtgcccttttccatcggtaagagaccactgtttgctgccaggccacggctcacaccagcaggggcctccctcaccctcctcccctctctgcggtgtagcctggtatttctccagcttggaagttcctgttagaatctacccttgagccagcagctgatacttccttaactaccaagcacccagtacctgcgcccaggtaaaatgaaaggaaacatctttccccgtagatgtatttctctagggtcacacagcagattcctcagatccctaaaaaggagatgacggcacagcagtcatatttgcaagtgtacctggcaggaaaggacatctaaacctcccattgctacacctggcatggatcaccccatctatgatggatgtgtgacattatgcctttttcaaaacccatagaactgtataacacagagtaaaccctaatgtaaactatggactttgttagtaataatatatca

SEQ ID NO: 444677 - DNA, 377 bp, Homo sapiens
acggggacttccagcccctctctgtgtccccagcatcccacccacattagaagctttctagaccctgtcccactccctcaatcagtcaaagaagacttccccaaccaccacatccgttccacctttccacttagacactcctgagtcctgcatctctccagactctttgtgtcaggagaatcaaacacatgttcccaaacttcctatcttaagaaacagaagccccctttccattcggccttttgtcatagggacagaaatctcaggtcccccaaactcctgcctagaaggacatggaccccatgtctcccaaacttcctgtttcagagatgtgaaccttctatcccccaaagctcctccatcagaggaccccaact

SEQ ID NO: 444678 - DNA, 324 bp, Homo sapiens
aaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctc

SEQ ID NO: 444679 - DNA, 618 bp, Homo sapiens
tctctctctctctctctctctctctctctctctctctctctctctctctctctctctggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggggaacggcccatgagggtaagggaagacacgacacacaagcgggtaagtaaccttgggggttcccacctgagatcagaggaaggaaccctaccatatgcttgaacaggagaattataccagctttaattctg

SEQ ID NO: 444680 - DNA, 2757 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggatgcttctggtggccttgctggtctgcctgactgtgatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagatccgcccccaccccccagactacggggacttccagcccctctctgtgtccccagcatcccacccacattagaagctttctagaccctgtcccactccctcaatcagtcaaagtcctgcatctctccagactctttgtgtcaggagaatcaaacacatgttcccaaacttcctatcttaagaaacagaagccccctttccattcggccttttgtcatagggacagaaatctcaggtcccccaaactcctgcctagaaggacatggaccccatgtctcccaaacttcctgtttcagagatgtgaaccttctatcccccaaagctcctccatcagaggaccccaactcctccatgcctgccacttccccttacctggggcacactagttccccctccagcccctgtgtactttcaccaatcccccgaccctcctcatcacacacaacttcctcctcccggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctcttatttcctcgcaaaaaaaaaaaaggaattc

SEQ ID NO: 444681 - DNA, 992 bp, Homo sapiens
gaattccggaatttccccagtgccccggaggctcgatgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctcttatttcctcgcaaaaaaaaaaaaggaattc

SEQ ID NO: 444682 - DNA, 2590 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaaggtgtcccaaggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccgcatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggacgaagatgccctacatggaggcagtgatccacgagatccaaagatttggagacgtgatccccatgagtttggcccgcagggttaaaaaggacaccaagttttgggattttttcctccctaaggtgctatcctccccaccccctagactacggggacttccagcccttctctgtgtccccagaatcctgcccccattagaagctttctactcactgtcccactccctcaatcagtcaaaaaggacttccccaaccaccacatccattccacctttccacttagacactcctgagtcctgcatctccccagactctttgtgtcgggagaatcaaactcaagttccaaggacacaaatttcaggtcccccaaacaacctgcgtagcaagacatggaccccatgtctcccaaacttcctgtttcagagatgtgaaccttctattccccaaagctcctccttcacaggaccccaactcctccatgcctgccacttccccttatctggggcaccccagttccctctccagcccctgtgtactttcaccaatcccccgaccctcctcatcacacacaacttcctcctccctaccagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgctacaccatgcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 444683 - DNA, 1437 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggatgcttctggtggccttgctggtctgcctgactgtgatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctactttgaccaccctcggctttggcttctgctgctaa

SEQ ID NO: 444684 - DNA, 2409 bp, Homo sapiens
gctcagcacagaggtaggaaggacagcagagctgacagtcacagcagccctgacaagagagttcctggagcccaagctcttctccacagaggacaagcaggcagcagagaccatgggttccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgtttttattatccacctgcagactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggtaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaattttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcatgaatcacaaataaaagccaattgtatctataaaaaaaa

SEQ ID NO: 444685 - DNA, 601 bp, Homo sapiens
gggcggtattttttttaaaaacccttaaaaatgttgggcaaggccacccaattttgttcaaaaattttcaaaaaatttttttttttggggtggggatgaaccaaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaattttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcatgaatcacaaataaaagccaattgtatctataaaaaaaa

SEQ ID NO: 444686 - DNA, 2130 bp, Homo sapiens
gctcagcacagaggtaggaaggacagcagagctgacagtcacagcagccctgacaagagagttcctggagcccaagctcttctccacagaggacaagcaggcagcagagaccatgggttccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctatgagtcagtacaagcaagttcacctgacctctcagctgggaccgctgtcagcatcatgattggagtactggctgggatggctctgatatagcagccttggtgtagtttctgcatttcgggaagagtgtttttattatccacctgcagactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggtaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaattttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcatgaatcacaaataaaagccaattgtatctataaaaaaaa

SEQ ID NO: 444687 - DNA, 2374 bp, Homo sapiens
agtccgtgtgaggagctcggaggggcgaggaggacgtgggccgaggtatctgccctggagaagtgggcagtaatttgacttccagaagttcttgacatctgcagatccgggcgacagccaagtgttcaaggttccagtgcccactggtgtgagggcacaagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggtaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaattttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcatgaatcacaaataaaagccaattgtatctataaaaaaaa

SEQ ID NO: 444688 - DNA, 2389 bp, Homo sapiens
gctcagcacagaggtaggaaggacagcagagctgacagtcacagcagccctgacaagagagttcctggagcccaagctcttctccacagaggacaagcaggcagcagagaccatgggttccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggtaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaattttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcatgaatcacaaataaaagccaattgtatctataaaaaaaa

SEQ ID NO: 444689 - DNA, 1699 bp, Homo sapiens
ggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaccaacaaaaaatatacgtgggaaaaaaaacg

SEQ ID NO: 444690 - DNA, 1791 bp, Homo sapiens
ggtggcggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaccaacaaaaaatatacgtgggaaaaaaaacg

SEQ ID NO: 444691 - DNA, 1590 bp, Homo sapiens
ggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggagggagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaccaacaaaaaatatacgtgggaaaaaaaacg

SEQ ID NO: 444692 - DNA, 1703 bp, Homo sapiens
gtgggtaacgaggagcagcgcagggttcgcagaacagattagaattctcccgaggcactctgggaagggccagcacttccggttttagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaccaacaaaaaatatacgtgggaaaaaaaacg

SEQ ID NO: 444693 - DNA, 1104 bp, Homo sapiens
ggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgttggatagcaactggatcgcgggttagggtgagggttacgcgggttagggtgagggtta

SEQ ID NO: 444694 - DNA, 1366 bp, Homo sapiens
ggtggcggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacatgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaccaacaaaaaatatacgtgggaaaaaaaacg

SEQ ID NO: 444695 - DNA, 946 bp, Homo sapiens
ggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaccaacaaaaaatatacgtgggaaaaaaaacg

SEQ ID NO: 444696 - DNA, 736 bp, Homo sapiens
gggctggtacggtcggagatgtatggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccagggaacacttgttaaaaggtaggtggggccgggtgcggtggctcacgcctgtaatcccaaagtgctgggattacaggcgtgagctaccggacccggccaccagccagacttagcaacaaggtgtgcctccgggatacactgctggcgatggcttcacacggggttgtgccagggaacacacggtagttcgtatggaacgtggtgcgttgggacatatcaagatttcttcacaagggacggtgaggaggtaaaggaaagggttccagatatttagtaacgaattg

SEQ ID NO: 444697 - DNA, 1676 bp, Homo sapiens
ggactgtgtggtgtggatgctgtgagcccagtgcctggtgagcatgtgctgcctgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaccaacaaaaaatatacgtgggaaaaaaaacg

SEQ ID NO: 444698 - DNA, 1464 bp, Homo sapiens
aggcgccgcgcacaggcgacatggggaacgtgttggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaccaacaaaaaatatacgtgggaaaaaaaacg

SEQ ID NO: 444699 - DNA, 895 bp, Homo sapiens
ggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggtaagaggcggagggcttggagggtggtcacaaaactgcagttctgagctcttcgccacgcaaatccaccccatttgtgaacctcctttctgccactggagaagtggctcagcaggagtgatttgaacatcaggcaacatactacagtggtagcgcaca

SEQ ID NO: 444700 - DNA, 589 bp, Homo sapiens
ggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccatttcccatctcctcggtataaatcatgtttataagttatggaagaaccgggacattttacagaaaaaaaacaaaaaccaacaaaaaatatacgtgggaaaaaaaacg

SEQ ID NO: 444701 - DNA, 426 bp, Homo sapiens
tgcccccttgggctccatacaagggtaatttagtttgggaaagtaactgctaggtgagagtcatcagccatactttgcagtggcagggagcagtcaggtgttgagctcatttactagagtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgaaaaaaaaaaaa

SEQ ID NO: 444702 - DNA, 3760 bp, Homo sapiens
tgactagcaggatccggcgcttgtgtggctcttcgcgtggcccctggaggacgctgacgtacgacctctgccttcgggacacgcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctggacatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttctgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggtttttgaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgaaaaaaaaaaaa

SEQ ID NO: 444703 - DNA, 2980 bp, Homo sapiens
atgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatgatggagtctcgctctgtcgcccaggctggaatgctgtagcaagatttcggctcactgcaacccccgtctcccgggttcaagcgaatctcctgcctcagccttctgagtagctgggattacaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgaaaaaaaaaaaa

SEQ ID NO: 444704 - DNA, 4110 bp, Homo sapiens
atgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctggacatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttctgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggtttttgaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgaaaaaaaaaaaa

SEQ ID NO: 444705 - DNA, 3631 bp, Homo sapiens
atgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctggacatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttctgagtagctgggattacaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgaaaaaaaaaaaa

SEQ ID NO: 444706 - DNA, 2832 bp, Homo sapiens
atgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccaagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgaaaaaaaaaaaa

SEQ ID NO: 444707 - DNA, 2914 bp, Homo sapiens
acattgaatcattgattcctaaaggattatcagagtttacaaaacagcaaatacgctacattctgcagatgaggggtatgtctgataagtcactccgactagtgctgtccacatttagcaacatacgggaggagcttggacatcttcaaaatgatttgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtccatgaatggatccactttaaagtattacaactcaaagccgttttttttgtgtgtgtgtgtctctgcattagtactttgttatttttccatcactaaaggccaatcagaatttggaaccatgctgctacccaagaaatctaatggaatgaattagttctgtagatgacaatttcttcacccatttatgagacctaaatcttttccataacactcatgtattcagtataacaacatactaactgaaagagggacctgattgtttaaagtttgattgcagacactgtagaacataactcattatgtttcagataaggtaactcctagatatcaaactaatttgttggggtagagattttacaagtcatgccattagaagattttctctgatattatatgtgcagttcagttacaagatgaaatcatgtttttttaacaaaagagataaaatacaattgaagcaaaaaataacagctagtatataatatatacagtctgtatttgcttttcacagtaggcctgatgactaaaagatatgctttattacacgctattttcacctcttgaaagtcaaaggtgatgattaatttcatttagcagggaagtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtaaggaaggtaagttttttcatagtggtatgcaaacatatcattgaaatattacatagatataaagacttagggaataaaaatagcagcaacaaatacttgatagatttatcctacttgggagaaatattttgtagcagagtatttagtatacttagaagttgatttagcaattaggctttaatgaccttacaaagtgaacataactgaacacaagtattttttcaatgcaagatgaggatgaaaattttacatttcaacccatctggctaaagttaagacttagcaaaaattaaaatgttgcctttgtccaagtatagattaaggcaacaaacatatttgggtgtgtaatttgaagttttggactgaaatatctttgcaagtatccacataaaattctgtaatgccttataattatattctaataattatgcattatactaagacaccattaagaacagttgaggcactacactaaatcaaaccataaatgaggaaaaaacttttaatgttcttttctagaagtgttcaaataggtcttgatatgaagctaaaagccttatttatattatcttaatatttcggctaaaatgttaagctccataacatgaattgatacaattccaattttatcaatattttgtgatagaaaaatgttaatattattcatgagctatacagtccttacattttttcccttggtgtaggaacaacggaggagtttctcctctgctaactattcatatatgtaactgtaacaaaagtgtactatgttatgcacacattacaaataatataaggggaagttttattagcttagtaggaaattgttattattaaggtttaaaaatgagaacaggtgtgagttttccaaaatacttaaaaataatagtgtcaaaaattcaggggcagttaaggagtcatggatggaactagaggtcactatattaagtgacataagccagaaacagacaaacattgcatgttctcaattatttgcgggatctaaaagtcaaaacaattgaactcatggatatagagagtagaaggatggttactagtggctgggaaaaggggtgtgcgaggggaactggggatgcttaatgtgtacaaaaactatgtagttagaaagtataaataagacctagtatttgatagcacaaccgggtgagtatagtcaataatagcttaattgtacaaataactaagagtataattggattgtttgtaacacaaataaatacttgagtggatggatacccaattc

SEQ ID NO: 444708 - DNA, 2824 bp, Homo sapiens
gtaggctgcctgaggatcccaggcaaagctcctaccgggaggagcttggacatcttcaaaatgatatgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtccatgaatggatccactttaaagtattacaactcaaagccgttttttttgtgtgtgtgtgtctctgcattagtactttgttatttttccatcactaaaggccaatcagaatttggaaccatgctgctacccaagaaatctaatggaatgaattagttctgtagatgacaatttcttcacccatttatgagacctaaatcttttccataacactcatgtattcagtataacaacatactaactgaaagagggacctgattgtttaaagtttgattgcagacactgtagaacataactcattatgtttcagataaggtaactcctagatatcaaactaatttgttggggtagagattttacaagtcatgccattagaagattttctctgatattatatgtgcagttcagttacaagatgaaatcatgtttttttaacaaaagagataaaatacaattgaagcaaaaaataacagctagtatataatatatacagtctgtatttgcttttcacagtaggcctgatgactaaaagatatgctttattacacgctattttcacctcttgaaagtcaaaggtgatgattaatttcatttagcagggaagtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtaaggaaggtaagttttttcatagtggtatgcaaacatatcattgaaatattacatagatataaagacttagggaataaaaatagcagcaacaaatacttgatagatttatcctacttgggagaaatattttgtagcagagtatttagtatacttagaagttgatttagcaattaggctttaatgaccttacaaagtgaacataactgaacacaagtattttttcaatgcaagatgaggatgaaaattttacatttcaacccatctggctaaagttaagacttagcaaaaattaaaatgttgcctttgtccaagtatagattaaggcaacaaacatatttgggtgtgtaatttgaagttttggactgaaatatctttgcaagtatccacataaaattctgtaatgccttataattatattctaataattatgcattatactaagacaccattaagaacagttgaggcactacactaaatcaaaccataaatgaggaaaaaacttttaatgttcttttctagaagtgttcaaataggtcttgatatgaagctaaaagccttatttatattatcttaatatttcggctaaaatgttaagctccataacatgaattgatacaattccaattttatcaatattttgtgatagaaaaatgttaatattattcatgagctatacagtccttacattttttcccttggtgtaggaacaacggaggagtttctcctctgctaactattcatatatgtaactgtaacaaaagtgtactatgttatgcacacattacaaataatataaggggaagttttattagcttagtaggaaattgttattattaaggtttaaaaatgagaacaggtgtgagttttccaaaatacttaaaaataatagtgtcaaaaattcaggggcagttaaggagtcatggatggaactagaggtcactatattaagtgacataagccagaaacagacaaacattgcatgttctcaattatttgcgggatctaaaagtcaaaacaattgaactcatggatatagagagtagaaggatggttactagtggctgggaaaaggggtgtgcgaggggaactggggatgcttaatgtgtacaaaaactatgtagttagaaagtataaataagacctagtatttgatagcacaaccgggtgagtatagtcaataatagcttaattgtacaaataactaagagtataattggattgtttgtaacacaaataaatacttgagtggatggatacccaattc

SEQ ID NO: 444709 - DNA, 1418 bp, Homo sapiens
acattgaatcattgattcctaaaggattatcagagtttacaaaacagcaaatacgctacattctgcagatgaggggtatgtctgataagtcactccgactagtgctgtccacatttagcaacatacgggaggagcttggacatcttcaaaatgatttgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtccatgaatggatccactttaaagtattacaactcaaagccgttttttttgtgtgtgtgtgtctctgcattagtactttgttatttttccatcactaaaggccaatcagaatttggaaccatgctgctacccaagaaatctaatggaatgaattagttctgtagatgacaatttcttcacccatttatgagacctaaatcttttccataacactcatgtattcagtataacaacatactaactgaaagagggacctgattgtttaaagtttgattgcagacactgtagaacataactcattatgtttcagataaggtaactcctagatatcaaactaatttgttggggtagagattttacaagtcatgccattagaagattttctctgatattatatgtgcagttcagttacaagatgaaatcatgtttttttaacaaaagagataaaatacaattgaagcaaaaaataacagctagtatataatatatacagtctgtatttgcttttcacagtaggagctttgcctgggaacctctagggcga

SEQ ID NO: 444710 - DNA, 3568 bp, Homo sapiens
ggtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtccatgaatggatccactttaaagtattacaactcaaagccgttttttttgtgtgtgtgtgtctctgcattagtactttgttatttttccatcactaaaggccaatcagaatttggaaccatgctgctacccaagaaatctaatggaatgaattagttctgtagatgacaatttcttcacccatttatgagacctaaatcttttccataacactcatgtattcagtataacaacatactaactgaaagagggacctgattgtttaaagtttgattgcagacactgtagaacataactcattatgtttcagataaggtaactcctagatatcaaactaatttgttggggtagagattttacaagtcatgccattagaagattttctctgatattatatgtgcagttcagttacaagatgaaatcatgtttttttaacaaaagagataaaatacaattgaagcaaaaaataacagctagtatataatatatacagtctgtatttgcttttcacagtaggcctgatgactaaaagatatgctttattacacgctattttcacctcttgaaagtcaaaggtgatgattaatttcatttagcagggaagtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtaaggaaggtaagttttttcatagtggtatgcaaacatatcattgaaatattacatagatataaagacttagggaataaaaatagcagcaacaaatacttgatagatttatcctacttgggagaaatattttgtagcagagtatttagtatacttagaagttgatttagcaattaggctttaatgaccttacaaagtgaacataactgaacacaagtattttttcaatgcaagatgaggatgaaaattttacatttcaacccatctggctaaagttaagacttagcaaaaattaaaatgttgcctttgtccaagtatagattaaggcaacaaacatatttgggtgtgtaatttgaagttttggactgaaatatctttgcaagtatccacataaaattctgtaatgccttataattatattctaataattatgcattatactaagacaccattaagaacagttgaggcactacactaaatcaaaccataaatgaggaaaaaacttttaatgttcttttctagaagtgttcaaataggtcttgatatgaagctaaaagccttatttatattatcttaatatttcggctaaaatgttaagctccataacatgaattgatacaattccaattttatcaatattttgtgatagaaaaatgttaatattattcatgagctatacagtccttacattttttcccttggtgtaggaacaacggaggagtttctcctctgctaactattcatatatgtaactgtaacaaaagtgtactatgttatgcacacattacaaataatataaggggaagttttattagcttagtaggaaattgttattattaaggtttaaaaatgagaacaggtgtgagttttccaaaatacttaaaaataatagtgtcaaaaattcaggggcagttaaggagtcatggatggaactagaggtcactatattaagtgacataagccagaaacagacaaacattgcatgttctcaattatttgcgggatctaaaagtcaaaacaattgaactcatggatatagagagtagaaggatggttactagtggctgggaaaaggggtgtgcgaggggaactggggatgcttaatgtgtacaaaaactatgtagttagaaagtataaataagacctagtatttgatagcacaaccgggtgagtatagtcaataatagcttaattgtacaaataactaagagtataattggattgtttgtaacacaaataaatacttgagtggatggatacccaattc

SEQ ID NO: 444711 - DNA, 5928 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacc

SEQ ID NO: 444712 - DNA, 5802 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagagaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacc

SEQ ID NO: 444713 - DNA, 5751 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacc

SEQ ID NO: 444714 - DNA, 5583 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacc

SEQ ID NO: 444715 - DNA, 600 bp, Homo sapiens
tcccctgttgaccaggggtcaaagtataaaatagtagaacaagaatagggacccaggtgtgtcggatttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatgggtaagccgggacgtggacacacgtgatggtgtggagagagccacagggcttttgttaaacgtggattcgaattcccaccgtgctccctctctgtgaccttgaacaactcactttgcctttctaagacttagcttacccatctggacaatgggtgcagatacacctgcttaggctgtcgtgagaagcagacacacatgcctagcacagagggttccctgggattgtaagttacagcagccttggacagctagacttagacaatacaggagattcttggcttgcgtaactgggaagttctactt

SEQ ID NO: 444716 - DNA, 6589 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaa

SEQ ID NO: 444717 - DNA, 5552 bp, Homo sapiens
tttgctgcggccatgcgctttgtggtgtgaatagggctcggggggcttgggagcctcgccaggccagtcgccacgctcctgctcattggaaaggtgcagggtgttgttcagggagccagccaggagggcgtctcgttcatggggctcgggatggcagaaggagcgggtggaggtgccgatgaatagcgagctattcatcgttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaa

SEQ ID NO: 444718 - DNA, 4086 bp, Homo sapiens
agcttaacatagcagggctactgttttctgggctgggttttacccattgctgctggcacaggatgctggctcaggcccagtgccctcagtggatggagccttctgcacagttgcaaagcactgtccctaccccaagggactgagctccagataccacctgccccacaaccagacagcctgttcatggcctctgcagagcaggtctcctactttctgatcatcctggcggccaggtgctctgtggtctcctcactgaagtggccggtttttgttgcccttggttttagcatctgcctcatataaccccacttgccccctttgtctctcttcttgccaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaa

SEQ ID NO: 444719 - DNA, 3871 bp, Homo sapiens
agacactgcctttctctgggtacctataaacctggagagtgacatggtgggggtgtggtgcatatattcatatatatgtttacatgtgtgcatgtggaaacactccgtctcttatgccatggttcagacccacaatagcagtcccagcagggagccctccgaccctgcccaaggcatctgtacggttgacacccttgtgctttgcttctccagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaa

SEQ ID NO: 444720 - DNA, 4594 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcaggcagcgcagatgtgtgctagccgaggcagctgcgacaagacatccaggaggatgggcacgagacgggccggaaaggaaacactcaccacaacgacaagcggagagc

SEQ ID NO: 444721 - DNA, 4363 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagaggtaagggcggggaggaaggccccaacctaaggaccctgccctgccagtgggaggacaagaggaggaacaaaaaaaggcctcagccccctgaggtcctggaaggcctgggcttttaccttccctcccaaatcctccaaggaccttgcttttcagagtacagaggcccaaagaaggaatgtggcactctttttgccaggtggcacaactcacacaggcctcatgatttaaccagctgtccacgcttctgacactcgggctccctacatggtgtgggtctttgctcaggtctcttggcggggcctggaaggttcaggctttgtgaagcagcatttgatttaaaactgtctcaaggccaggtgtggtggctcctgcttgtaatctcagcactttgggaggttgaggcaggaggatcgcttgaggccaggagtttgagaccacagtgggtaacatagcaagacctcatctctacaaaaaaggaagtatgctcgtgtttgattatagagggcttccttagatccctggggatttatagcgtatgcagtatattaaccatcctagcttttaaaaaactggctaagtcggccaggcagggtggctcatgcctataatcccagcacttcgggaggctgaggcgggcggatcacctgaggacaggagttgaagaccagcctggccaacatgatgaaaccctgtctctactaaagatacaaaaattagccaggcatggtggcaggcgcctgtagtcccagctactcgggaggctgaggcacgagaatcgcttgaacccaggaggtggaggttgcagtgagccgagattgcgccatggcactccagcctgggtgacagagcgagactccatctcaaaaaacaaaaacaaaacaaaacagcagcagcagcagaaaacagtaaaacaacaacaaaaattgacaaagtcggagcctaaacgtatcagaccgcggagatctgagaaaggatcccggacctgcagttgctacaggggtcaggagagagcaaagaccatgcggcatagcacggtgcctggaacagacaaacacttcgtagatgtcgcttttgccatggttatcatccggacatggttatggtccggaattggtgggtcttggtctcactgacttcaagaatgaagccgcagaccctcacggtgagtgttacagttcttaaaggtggcacgtctggggtttgttccttctgctgttcggatgtgttcggagtttcttccttctggtgggttcgtggtctcgctggcctcaggagtgaagctgcagaccttcgcggtaagtgttacagctcttaaggtggcgtgtctggagtcgttcgttcctcccgctgggtttgtgctctggctggcttcaggagtgaagctgtagaccttgatggtgagtgttacagctcacaaaggcaatgtggaccc

SEQ ID NO: 444722 - DNA, 1824 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggacaaaagagggtaagtcctacatgaatgctgagaagggctgcagactgaagcccggggagc

SEQ ID NO: 444723 - DNA, 675 bp, Homo sapiens
gctggtctcaaactcctgaccccaagtgatccagccaccttggcctcccaaagtgctgggattacaggtgtgaaccaccactcctggccatgattgttattttgtattgttttgaaatcaggaagtgtgaatcctccaacttgattcttatttttcatgattgttttgactgttctggatccttgagtttccatgtgaattttaaagttagctcataatttctacctggcagccagctgggcttttgatggggattgccttgactctagatcagtttggagccatcagttttctaagtctttaacttattcaactcgtttaatcttacctaccttggaggtaggtcctacttttatcctcatttcacagaggaggaaactgaggcccagagagcttaaggaccttgtctgaagtcacgcagctggccagtggccaagccagaccttgagccggtggctctggagcccgtggctctggagcccgtgtttgtaaccactgtgctgagctgcctctttccctgggcttgttgtctttgactctgccttccctgaagggtgacattccctggccatgtccctgtggtagggggctgcatctctggcagaccccacaacggcttcacctccttgtgttccaggcagccggtgaaggttgtgtactcctccaaggatcctg

SEQ ID NO: 444724 - DNA, 393 bp, Homo sapiens
tccaaaagtgctaggattacaggcgtgagccaccacacccagccccagaatgtgatctttttcttccttccttccccaccatgtaggatgcccaggtggacctgtttcgtgacatcactttctacgtctacttttccctcttactcattcagctcgtcttgtcctgtttctcagatcgctcacccctgttctcggaaaccatccacgaccctgtaagtgtgaccacagatgagtgtgtgtgcgtgtgtgtgtgagagagatgcgtgacacagtaccagctaacatttcttagatccatccaggatctcgttccagcctccctcaacccctgatacagggaatatcatcccacctactttacagatggaaaaactgaggcttagatgtggctgg

SEQ ID NO: 444725 - DNA, 231 bp, Homo sapiens
tctgggtctggggctgcctccagaactgcaggttgagtttcttctttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaa

SEQ ID NO: 444726 - DNA, 5760 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacc

SEQ ID NO: 444727 - DNA, 5781 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacc

SEQ ID NO: 444728 - DNA, 5733 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacc

SEQ ID NO: 444729 - DNA, 4703 bp, Homo sapiens
tcccctgttgaccaggggtcaaagtataaaatagtagaacaagaatagggacccaggtgtgtcggatttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaa

SEQ ID NO: 444730 - DNA, 3572 bp, Homo sapiens
gcttgcgaccgtatccgctagcgcggcctgggatgcgcttgggctccctggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaa

SEQ ID NO: 444731 - DNA, 3521 bp, Homo sapiens
tcgttgacctcaaagcctatgctgaaaaccacactgctggttccagaaaaccctagaggtgaaaggcttcagagaggcagtacagggtagaggttagcactttgcagcccagatggcctgggtttgaatcccagttctgccccttgctagccatgtgaccttggggaggagattaactagcttctttgtgccttagtctacccatcacatataggaatgagcacctcaggttttttgtgaggattgaatgaactgatgtttgtaaaactgcttagaacgatgcctggggctgtgggctttgtataagcgtgagctattattgtcactgtccttgtcattggtggtgctattcctgtggttcaccaggtgagtgggcacccctgtgagggcagcccggctctaacattttgcctcctggaggtatcggttacgtctagatgttctccagcacagccctgccctgggaggatggcaggagggaaccttcatcaactccccgcgtctgttctctaccccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaa

SEQ ID NO: 444732 - DNA, 2197 bp, Homo sapiens
ccaggcggcgttgcggccccggccccggctccctgcgccgccgccgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccacgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtaaggcatgtgtctctgcgggcccccaagccgggccctaggcagaggcctctccatgaggattttagtccagttccttctgctctgtccctggggttctcagccttgcctgccagttggactcacttggggagccttaacaaatgctgatgccccggctgcatatctgggattctgattcacttattgtgggtggggtctggacatcaagatgttttaaagcttcccaggtcattatattgggcagccaagattgagagctcctgacacatggttagaccttgtaggccggtgactggaatcagaaggtctgtgagcctctgagaaagtccttgtttcccacggtcttgtttattatgtgtatgtgtgactcagctttcaagagttgagtacaaattaccccctacttttttcccccttattagctcttaccttataggatacatgctgttaatctctttatttaaattaaaataattaatttctaaaatggggcctgggcagcatggtgaaaccccatctctattg

SEQ ID NO: 444733 - DNA, 731 bp, Homo sapiens
gggagacagaatacactcaagcatgcgagccccaagagggctggggacaggcagtgccctgaaggagaaggcagtgcgggaggggacagagggacacagggctgagagggtgctctgtatcgaccagagatccacaggatgcaagggggtcatttggggaataacattccaggaagggcaaccccccagtgctgaggcctgggaggccaccttgggcagcagagtgagtgagaggggaggtcaggggagtcacagctttaccagatggactggaaattccttactctctcccttcactgcgatcgaaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtgggtacacatcgccccattccctcacccattcccagtcgggcacagggtgccatcgggcaggtgaacctagctgcagcgtctccccagtcactcacggctccacacctttgcttgaatggctttttggggggctgggagtggactgtggcagtaaaagctgttcagagcgcatacaacttgcagaagtgaaggcttttaggtgaactgacagcctgaagaccaaatgagccccacagatttgttttggaagattttttgttgttgttgttgaga

SEQ ID NO: 444734 - DNA, 2974 bp, Homo sapiens
gaagtttgcaggagacccgcgctgcctaggcaaagggacccggcgaccaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgcctctccctctcggaaggagccatcgccgctttaagtggaagaggagaggaagggggcgggggagcggggggcggggagcggaggcggaggagggggagggggatccccctggctcccacgtggtccgggcgcctgtgaatcgcgcccaccggagggtctcacagcgaaatacaaaagcagctgggaagcggcggggactcgagttcccagcgccgggcggagcgccggacagagccccgcagcgccccgcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaaaaacttcagcttttcacccacctgcccctttctttcaatcccacgctgtttcctttcaaagttctgggaggacgaactcaccgaggcgagaagtgtaacattctctccacccagcttataaaaggattctttactgtgccagcacggggattggatccgaagaaactggctactggggtttggcccccgagtggccgtccctgtgggagatgcaccccattcttgggcccccctcattccctttccgaaaaaggaaaacttgcgtttgagccgttgagctaattctgcaattttctaccaaacagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaatcagttttatgcactttattttgttttgattttcattttttattaagaaaaaattttattttacagaatttaccttctctgtatatatgtgcataaagtgtggtgtaaatatactaaacaaacttatatttcaataaaagggagtttaaaatttataaaaaaacacaaaagggggcggttaaaattccctgagggccaagttaggtacccagttcttgtaaagggcccaagggacgattaagaggcggggcgtaaagctgcggaaacgctggtcgggactttggcggatgcaccccaatagggataatagtaggacgttggatgtggtcgg

SEQ ID NO: 444735 - DNA, 2801 bp, Homo sapiens
gaagtttgcaggagacccgcgctgcctaggcaaagggacccggcgaccaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgcctctccctctcggaaggagccatcgccgctttaagtggaagaggagaggaagggggcgggggagcggggggcggggagcggaggcggaggagggggagggggatccccctggctcccacgtggtccgggcgcctgtgaatcgcgcccaccggagggtctcacagcgaaatacaaaagcagctgggaagcggcggggactcgagttcccagcgccgggcggagcgccggacagagccccgcagcgccccgcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaaaaacttcagcttttcacccacctgcccctttctttcaatcccacgctgtttcctttcaaagttctgggaggacgaactcaccgaggcgagaagtgtaacattctctccacccagcttataaaaggattctttactgtgccagcacggggattggatccgaagaaactggctactggggtttggcccccgagtggccgtccctgtgggagatgcaccccattcttgggcccccctcattccctttccgaaaaaggaaaacttgcgtttgagccgttgagctaattctgcaattttctaccaaacagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaatcagttttatgcactttattttgttttgattttcattttttattaagaaaaaattttattttacagaatttaccttctctgtatatatgtgcataaagtgtggtgtaaatatactaaacaaacttatatttcaataaaagggagtttaaaatttataa

SEQ ID NO: 444736 - DNA, 2488 bp, Homo sapiens
gaagtttgcaggagacccgcgctgcctaggcaaagggacccggcgaccaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgcctctccctctcggaaggagccatcgccgctttaagtggaagaggagaggaagggggcgggggagcggggggcggggagcggaggcggaggagggggagggggatccccctggctcccacgtggtccgggcgcctgtgaatcgcgcccaccggagggtctcacagcgaaatacaaaagcagctgggaagcggcggggactcgagttcccagcgccgggcggagcgccggacagagccccgcagcgccccgcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaatcagttttatgcactttattttgttttgattttcattttttattaagaaaaaattttattttacagaatttaccttctctgtatatatgtgcataaagtgtggtgtaaatatactaaacaaacttatatttcaataaaagggagtttaaaatttataa

SEQ ID NO: 444737 - DNA, 711 bp, Homo sapiens
cttgatttcccttctcagaatgtcttttattttaagtgtgatggtaaaattatactaaaaatgcatttgtcaggacttgaaagacagtgagagtgattcaagctcagaggaagagcggagagtcactacccgagttattcgccggcgtttgattataaaggtatcctgtagctggatcattatgtggcattgctctactattagaaactccttccttgtggttgtagaaactccttccttgtggttgtgaaatttcagcatgcttgataatgaaatggctttgtgtaatttttttgcacccttgaaagcttgtaaaaacaacaaccaaaaagaaaagaagccatgttgcatggtattctgtataggcctatttgatatgtggcggttgtagttttatttgagaattcttggcatttgtatcctgctttccttgaagaagtgttatgtgaatgagcaaagattctgtcttggtgacacagtagttcatatcaaatgaaatgtttaattgaaaccttagaaactgtaacaaggtatgaggcacgataaagaagaaagagaatgaaagaattaaaaggcttccttctcagtctcaaattcctactgccttaagaatttttaaattaaaaccagttcttcataagcaatcagtggctgagaatttgaggttataacctggcatggatatatgtgacacaatgcaagtcaagtaaa

SEQ ID NO: 444738 - DNA, 14767 bp, Homo sapiens
gggacaccatcatttgggtttttaaaagcttcagcttctccagcatctttgcattgtgaatatcttcctgcttctagtcaaagctttctctctagtgattggaatgctgctgtaagcctattagaggtgcctgaggatatcaccttttacaaggaagccgtgtgtgcttgagaggatctttttaaatgcattatggctcatgcagcctcacaattaaagaaaaacagggatttagaaatcaatgctgaagaagagcctgagaaaaaaaggaaacaccgcaaacggtcccgggatcggaagaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgattgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatccttacggacaatgtcttcgccgataaaaactgtggtgtcacaatctccatacaatatccaggtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcacgagttgatgtcatttcatcagccaaaattacaatggcatcttctctctcatcacctgtgaagcagatgcctggacatgcagaggtagcattagtcaatggatctatttcccctctaaaatatgcatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgagggaggacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaacgactggtcctaaaccactttttcatgaagttcccatccctcctgttattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacccagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444739 - DNA, 866 bp, Homo sapiens
cagtcagcagaagggagaaagattaggtatcctggtatgttatgctcacaccctgtcaataagaaggctcttgaactcttatctgtgagtcttggactttaaatgcagacttcactgctcatcatcaatagaataattaatcagttctggaaagcagtgcccttatgtcatatctttttgtttgtttgttgtttggtttgggttttgtgtgtgttttccttatgtcatttctattgttcattatttttatgttttttttttttcagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaaggtacctataattccacagcctaaggagactgatgggtaaggtctatcagtctctatctgcacatctacttctgcttcagcaggagcaccctcctagtttagccacgacactaaaaaatc

SEQ ID NO: 444740 - DNA, 753 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagagacacttcataaggtactggatatccttgagcaaccaggggatggaccttttttccagtagcctctatcacatttcctttctgctcatttttctctgaagaataactgcacaaagcaaaccacaccatttaaacttggttttgaaacgtctttaattggcttatgcaggaaacatattcttgtcactgctaatcggctcagttgcagtttatttt

SEQ ID NO: 444741 - DNA, 732 bp, Homo sapiens
cagctgagaacaaagttgaaagtttgcctggagctccatgccactccccgcctgggccactgctttgttttcttctaatgtttttcctctacctgggttggctgtttcttcattcatatttgagaagaatcacctcctaattaaatgtagcacttcgctctctccctacatgaaggctgtcttggttacccgactaggcaacgcgcattggtatcaaattaccgaaagtctacaccggagcagtcctcatatttacatacaaataactcaggggcttgcatttatgtcaccattctgtcctgctagaggcttgccagaggagtttttaatccaatcagaaggagctttaaaaggatgtctgcgaagtggtcaaaaggatcttaacctcaattaagtggggttttttaaaaagattttttggggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtaagatctttgagttgtacttggtgtgtgctgtttttgtttgagatgcagtgaatgtgcaaatag

SEQ ID NO: 444742 - DNA, 370 bp, Homo sapiens
atgcttgaatgttgttgactgctaaataactgtcagtgaagtcagcctttttcccttgcactggagtagcaagtagaatttacaacttatttctctaaaattccagagcatgtgtgtggtgtttggagtagtgtggagatttctccatctagtatgttgctaatctttatgccacatcctttagggagaggaagcaaaaaacattcctggtgaatctgtcacagaagaacaatttactgatgaagaaggcaacctcatcaccagaaaagtaatcatcattcagatttcatgcttctcttggaatttagattttctgcattaaaaactctgctacttttgtgctgtagtgtcatctcctaaaacagaaaaa

SEQ ID NO: 444743 - DNA, 1122 bp, Homo sapiens
agactctgtctcaaaaaataaaataaaataaaataaaataaaataaaataaataaaatgtccatattaaattatgttttccctacttaggaatgcaggatacatgagggcactatattcatgtaccacttggtttaccagtatttgcttacttaatcatgatttcttaagcaatcatagaaaaccactagaaagagacataaactatttgaaaatgcactgtgcacatttttatcttgttcctgggcatgtgaccaagtgatttgtgttgacagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaaggtatacggccctcccttgccacacggaaaagaatgtgtccatttggtgactgcagtaaggaagaaactataattgtatcaggagaacaaaccctttaatcatctcttttctacgtagtattttaaatgtttatttatgcaagggacactaaagtctccggttgccgtattccagggacttttgtcttcaacggcctgggtacttgattctagctgcacagtaatttccccctatattaacactgttgagcctccttacaacaaatgtgtccttcggggcagagtgtgaaagcttgtacctttcttagtttttgtgatggatgttttaaatgcagacaaatagacaaatagaaaaacttgtaatttgtgacctctacgttcgttcagcatgatttatgaaacaggataaattaaggcttatttaaatattactcacttgctaaattcctaatggtctgtgcggtcatgcgtgtgttctccctctctcagacgagaaagctctcatttcaaaaagaaaaaaaaattgctaattaatcttatataatgccacaa

SEQ ID NO: 444744 - DNA, 7453 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggtaaactgcatcttcctaccaatcctccccctgtaaatgagggtgagagcttggttagccgaatcctgcagcttgggcctcaaggaacaaaatttattggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444745 - DNA, 15220 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgattgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatccttacggacaatgtcttcgccgataaaaactgtggtgtcacaatctccatacaatatccaggtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcacgagttgatgtcatttcatcagccaaaattacaatggcatcttctctctcatcacctgtgaagcagatgcctggacatgcagaggtagcattagtcaatggatctatttcccctctaaaatatgcatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgagggaggacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaacgactggtcctaaaccactttttcatgaagttcccatccctcctgttattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacccagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatgtcagtccaaatgtactgtcttccataggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444746 - DNA, 7318 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444747 - DNA, 7296 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttatctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444748 - DNA, 7405 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaaggtcaaaagtccgggtgcggctcctacacggatgactgcctgctgttataagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444749 - DNA, 3068 bp, Homo sapiens
  misc_feature (61)..(61): n is a, c, g, or t
  misc_feature (80)..(80): n is a, c, g, or t
  misc_feature (97)..(97): n is a, c, g, or t
  misc_feature (203)..(203): n is a, c, g, or t
  misc_feature (283)..(283): n is a, c, g, or t
  misc_feature (316)..(316): n is a, c, g, or t
cgaggcggtgatcgcgtaggccgatgacgagcgaggcgatgtccgacgagcaccgcgcganaggagcgcggctgccgcgngacgggcggacgagganatgcgtcggaggggcatcgggcgcgtggcggacgaccggcgtgattacgggcggcgacgtagggcgatgacctgcgtgaataggggcggaagcgcgggacgatagncggcgggaacaccgcggatacgggacgcaagaagtgatggcggagtggtgcggcggttagtagaggcgcggcgggacganagtgggcgtgggccgcaatcggggtggcgacanaggatatcgtgaggcggatggggcatggcgggcggccggaaatgcggggggtatgggcggtggagacggggggcgagcgggagatacggggtgaacggaaggcggcggtaatggcacgaacggaagcggcagacaataaacggcgaggagggacgggcggggaataaactggggtgggggtgctggggggtgcggagagagccaatgggcgatatgcgggggtaatcctgggcgtgggcgaaagacgggggcggcacacaagggggcggcgacgcgccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacagctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444750 - DNA, 13183 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgattgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatccttacggacaatgtcttcgccgataaaaactgtggtgtcacaatctccatacaatatccaggtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcacgagttgatgtcatttcatcagccaaaattacaatggcatcttctctctcatcacctgtgaagcagatgcctggacatgcagaggtagcattagtcaatggatctatttcccctctaaaatatgcatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgagggaggacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaacgactggtcctaaaccactttttcatgaagttcccatccctcctgttattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacccagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggtaactactttacccccgccattcttctcaagtcatctgtgaccagttttgttacacagctaaatgacatttcccaagacagtgatcactacagttcatgctccatagctccaaggaatagtttaatgcatttatctatcatgcttcagagtcccctgaactgctggctatctcaacatctcctcttttctcttagtctttctgtgtttcctctcctctttccatttactttgtctgtatcctaatttcttctttttaggctacgcccggggtcctcta

SEQ ID NO: 444751 - DNA, 3044 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaaggtatacggccctcccttgccacacggaaaagaatgtgtccatttggtgactgcagtaaggaagaaactataattgtatcaggagaacaaaccctttaatcatctcttttctacgtagtattttaaatgtttatttatgcaagggacactaaagtctccggttgccgtattccagggacttttgtcttcaacggcctgggtacttgattctagctgcacagtaatttccccctatattaacactgttgagcctccttacaacaaatgtgtccttcggggcagagtgtgaaagcttgtacctttcttagtttttgtgatggatgttttaaatgcagacaaatagacaaatagaaaaacttgtaatttgtgacctctacgttcgttcagcatgatttatgaaacaggataaattaaggcttatttaaatattactcacttgctaaattcctaatggtctgtgcggtcatgcgtgtgttctccctctctcagacgagaaagctctcatttcaaaaagaaaaaaaaattgctaattaatcttatataatgccacaa

SEQ ID NO: 444752 - DNA, 3483 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaaggtaatagatgcacatggtacaaaattcccaaggtacaagagtttacggtgaaaagtgaagatgcaatgaccggggacacagacaaatatcttgggccacaggaccttaaggaattgggtgatgattccctgcctgcagagggttacatgggctttagtctcggagcgcgttctgccaggtacttcgttgttgctgtctttcatagttaatttaaaacaaccatgatttgtcataaatcaaaatcatgttcatttttcacattatcccaaaatgtgttctttggatgaagatgtgaatttagcgaaatgttctcgacgcaaatacacatgctctgctattttcttttgtggtttgcggttgttaatttcatgtgattgaacatgttaattgtgtgttctttttttttttcccactttgcagtcatgctgccagcacagtagcaaaagagctcactgacaaaactgggagaaccaatctgagtcacatatttcaaaattaagttttgttccatattgaaagaaagtattatttgctaataagtgagaaatatgtgtatagattgttcactattctctgttactgaaataataattcatgattaaaagagagcatttttgaaaaaa

SEQ ID NO: 444753 - DNA, 302 bp, Homo sapiens
ggttgtctgtttttgtttttttccttctcacttaaaaagtaaacttcatgattgggaaaaaaaaaaaaaaaagtcactttcatttaaagtcctttctctgtctctaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctc

SEQ ID NO: 444754 - DNA, 171 bp, Homo sapiens
catacttctgttttttgttttgctcagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatg

SEQ ID NO: 444755 - DNA, 363 bp, Homo sapiens
agtgctgggattataggtatgggccactgtgcccagcctaagtctaaaaatctttataagatggtctctaaaaaaaatctgattgtaagtcattacctaaggagagttaagtcacagcctgtgtatggtcactactttgctatgaagccaagtatataaaaattaattcctgaggctgtacttgagcttgactataaaattcccttttctttttgtggcaattgagcattacttttatgaaacgtgtgataaaagtagaatatgcaatcttagtaactctctttcttttctacagaactggcaagggaactgaatttttcagtggatgaaatcaatcaaatacgtgtggaaaatccaaattct

SEQ ID NO: 444756 - DNA, 335 bp, Homo sapiens
tagggccttgtcctctaaggcatctagcaggtagcagcatcatgttaaaccaccccatagggaatggagggcctctattccctaagacttttctattgaatggcaagtaaggcttacactagttgtcttaaaaaaaaaaaaaaaaaaaaaaaaaaaaaagaaaaagaaaaagaaagctaaactcactatctactgtctctttccacaggatcataagtttttactgccagtattgagaaattcgtggaagaaatgtcagcaggaagtaaaaattcaccgagaagtgtgtgtgtgttcgctgcttccacacattaatggcatgattttttttatgc

SEQ ID NO: 444757 - DNA, 3444 bp, Homo sapiens
ggagctcttctcactcaagcccgagtttctatgttcagacatagtacattcatcactgtgtccttccaggatttggaagtctgacaaaacaccattccagtagctgcatctccaggttttgagtctagaaatgaatttaagatgtgttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtgagtttcctgacacgtccactaatccgggtcaatgttttaggagaagagacattttttctatgcgctctaaattatgatgtggtttcgaaaataaacgccctgggcc

SEQ ID NO: 444758 - DNA, 7354 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444759 - DNA, 5905 bp, Homo sapiens
cagtcagcagaagggagaaagattaggtatcctggtatgttatgctcacaccctgtcaataagaaggctcttgaactcttatctgtgagtcttggactttaaatgcagacttcactgctcatcatcaatagaataattaatcagttctggaaagcagtgcccttatgtcatatctttttgtttgtttgttgtttggtttgggttttgtgtgtgttttccttatgtcatttctattgttcattatttttatgttttttttttttcagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444760 - DNA, 7621 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444761 - DNA, 7594 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacagctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444762 - DNA, 3095 bp, Homo sapiens
  misc_feature (61)..(61): n is a, c, g, or t
  misc_feature (80)..(80): n is a, c, g, or t
  misc_feature (97)..(97): n is a, c, g, or t
  misc_feature (203)..(203): n is a, c, g, or t
  misc_feature (283)..(283): n is a, c, g, or t
  misc_feature (316)..(316): n is a, c, g, or t
cgaggcggtgatcgcgtaggccgatgacgagcgaggcgatgtccgacgagcaccgcgcganaggagcgcggctgccgcgngacgggcggacgagganatgcgtcggaggggcatcgggcgcgtggcggacgaccggcgtgattacgggcggcgacgtagggcgatgacctgcgtgaataggggcggaagcgcgggacgatagncggcgggaacaccgcggatacgggacgcaagaagtgatggcggagtggtgcggcggttagtagaggcgcggcgggacganagtgggcgtgggccgcaatcggggtggcgacanaggatatcgtgaggcggatggggcatggcgggcggccggaaatgcggggggtatgggcggtggagacggggggcgagcgggagatacggggtgaacggaaggcggcggtaatggcacgaacggaagcggcagacaataaacggcgaggagggacgggcggggaataaactggggtgggggtgctggggggtgcggagagagccaatgggcgatatgcgggggtaatcctgggcgtgggcgaaagacgggggcggcacacaagggggcggcgacgcgccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttca

SEQ ID NO: 444763 - DNA, 4205 bp, Homo sapiens
  misc_feature (4101)..(4102): n is a, c, g, or t
  misc_feature (4105)..(4105): n is a, c, g, or t
  misc_feature (4107)..(4107): n is a, c, g, or t
  misc_feature (4113)..(4114): n is a, c, g, or t
  misc_feature (4119)..(4119): n is a, c, g, or t
  misc_feature (4122)..(4122): n is a, c, g, or t
  misc_feature (4127)..(4127): n is a, c, g, or t
  misc_feature (4131)..(4131): n is a, c, g, or t
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagagtggttgtgtgatcgccatcttagggaaaagatgttctcgtccgtggcgcacctggcgcgggcgaaccccttcaacacgccacatctgcagctggtgcacgatggtctcggggacctccgcagcagctcccaaggggccacgggccagcccgcggcctcgcaactgggagcgcgcgtggaagagtacagttgtgaatttggtccggaagtatatgcactggtggcttggggggctaagtggggtnnccnantggtgnncctgnttntgatncgtnggtggccccaatagggtttacggtccgccaaagggggtcgtggaaaggcgcctgaccggctgtgggtgagcagg

SEQ ID NO: 444764 - DNA, 4192 bp, Homo sapiens
actctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaaggtaagaggtcaccagccactctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacaggtttggttaagtcactgctgtacttcctattgattcacaaagattgtgtacaaagatatatttgtgtacaaagatataaaacctttgaaatatccatgccaacattataagagaaaataaaagaacaaaacattt

SEQ ID NO: 444765 - DNA, 355 bp, Homo sapiens
cgcgcccagcctcatctattttaatattacctttcttctagaaaatgatcccggtcatagaaaatgatcctggtatatttatgtcatataaaatcctttgtaaaatatgtatttaagtctttaaaaagcaagttcatttttaaatattcagtaaataatagcagaagtggcaaaaaaaatagcaaaggtggtatgggaatgactggggttttggaagttctgacccagggggtgatttatgaaggacagaatgcaggggaaggatttaaaagggacagcaggcaagaacactagggaagtaaggaaactatgagaagataaagggtccaacatccgaggcagacctagaccattc

SEQ ID NO: 444766 - DNA, 4721 bp, Homo sapiens
  misc_feature (711)..(711): n is a, c, g, or t
gaaggttgcagtgagccgagatcatgccattgtgctctaccctgggcaacagagcaagactccttctcaaaaaaaaaaaaaaaaatctaatcgttaaactttcaggaattttgtgagctgattgtaaacataacagttattacaaattaaagtatataaatgcacaagtacataaatgatcatatttaatacatcatttcctacttaatacatcatttcctactatctgtgcacttgaggttatttgcatctattggtagaaatactattaatacataatagtgtcctgctgcagtattgatagaacattaccccattgtaatcagtaaaatacaaactagaatttgatttattatttgttgattaaacttaagaaagtgaaggatagaatgttaatgcagattaaatttcaaagtgtgatgtgtctctgctagactaaatgcaatacaaaaaaattgaggaagttgctttgcaatattccaaaactcggccaggcatggtggctcacacctgtaatcccagcactttgggaggccaaggctggcagatcacttgaggtcaggagttcgagaccagcctgcccagtatagtgaaacctcatctctaccaaagatacaaaaactagccgggcgtggtggtgcatgcctatagtcccaactaattagccaggtgtcgtggcacgtgcctgtaatttcagctacttgggaggcngagacatgagaattgcttgaacccgggaggtggagtttacggtgagctgagatcgcgccactgcactccagcttgggtgacagagcgagactccgtctcaaaaaaaaaatttttttttaaactcttcattagttcggaaagatgttgatgtcattgatgaatgagcgaaactctaatatatgtctttattgtttcactttcatcttattcattaatgtaattgaaaatattatccacccttcatgttgctactacagtcagcccttcatatactgtgggttccacatccgtggattcacccaactgtagatggaaaatatttttttaaataataaaaatacaataataaacacattaaaaagtaatacattataaaaacttttatggcattgatattatattaggtattaaaaataatctagaaatgacctcaagtatagaggaggatatgcaaaggttgagtgcaaatacttcattttatacaagggacttgagcatgggaggattttggtatggggaggtgcaaatagcatactcatttgcgaaacatatgaccaaccattttgctaattggatgataattcatagtcaaattttgtgaaactgttgttggttgtagaattttaaaaactaatagtgggtttttcaagaaatagcaagtcatattgatattatagatataaactgaaaatcaggttaaatatttaagtttaaaatgtatttccaaaattagataatcactaagagaactttttacattgacccttaaagtgttatgaattttacttacatatgtaaaattatttttcagattctgtttcctaaaatgccaaaacgacagggtgattttttgcattttttaaatgtgaagaaggtgaaaacagacacagaaaataatgaagtgagcaaaaatcactgcagattgtctaaggcaaaggaaccacatttcgagtatattgaacaaccaatcattgaagaaaagccatcactttcatcaaagaaagaaatagataatcttgtgcttccagattgttggaatgaaaaacaagcatttatgtttacagaacaatacaaatggcttgaaataaaagaaggtaaattaggatgtaaggattgttcagcagttcggcatttgggatcgaaagcagaaaagcatgtccatgtgtccaaggaatggattgcatatttagtaacccctaatggcagtaataaaactactaggcaagcttctctacgaaaaaaaattagggaacatgatgtttctaaagcccatggtaaaattcaggatttgttaaaggaatcaactaatgattcaatttgtaatttagtgcataaacaaaataataaaaatattgatgctactgtaaaagttttcaatactgtttacagtttagtaaaacataacagacctttatctgatattgagggggcaagagaattacaggaaaaaaatggagaggtaaattgtttaaatacacgttacagtgcaacaagaatagcagaacatattgcaaaagaaatgaagatgaagatatttaagaatattatagaagagaatgccaaaatctgtatcataattgatgaggcatctacagtttcaaagaaaaccaccctagtgatttatctccagtgcacaattcagtcagctcctgcacctgttatgttatttgtggctttaaaagaattggtgtcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgtcacttgatgattctatatccgaaataaaacaaattaatcatttaaaaatatttattgataaaatttattctatttatcatcaacctaataaaaatcaaaccaagcttctaggaactgtagctaaagaacttgaaactgaaattattaaaattggtcgagtaatgggaccaagatgggcggcatgtagtttacaagctgctactgctgtatggcatgcatatcctatattatatatgcatttttctcattcttactctggtttggcgaagagattagctaacattaatttcttacaagaccttgctttaatgattgacattcttgaagaattttcagtactttcaactgcattacagtcaagatcaactaatattaagaaagcacaaaaattgatcaaacgtaccataagagctttggaaaatttaaaaattggtactggaaagtatgaatctcaaattgaagatttgatcaagtcagataagtttaaagatattccatttaataaaaacaataaatttaatgctcttcctaggagtatattactagacaatataattcagcacatgaacctacgccttttatctgacagaaaccatgaagatatttttaattactttgatttgctggaaccttccacatggccttatgaagaaataacttcaccatggatagctggtgaaaaaacattatttcatttgtgtaaaattttaaaatatgaagttgatttgaatgattttcgggaatttgtaaataataatataaaatcaaacaatgtttcaattcctacaactatatacaaagctaaaaagatagttagcaccattgcaatcaatagtgctgaagctgaaaggggtttcaatttaatgaacataatttgtacaagggtgagaaatagtttaacaatagatcatgtatcagatttaatgacaataaatttactggggaaagaattagcagattgggatgcaacaccgtttgtaaaatcttggtcaaattgcaaccacaggttggctacagatacaagagttcggcaaaagtcaacaaaagtcttccatgagaatcaattggctatatggaacttaaaatagaatattgtatacgttttttgtcatctgtaaattatgtactacacatcctttatatacataaaggtctttttttttttttggaaagccagttaaacttttatcagcatgttgctgtttaaaaggcgttctttaagaagataatcttgaagattggttttagaagctatagttttttagagattggcccatgtttgctagagtgggtcataatacatattccatgaagttctgtacagaacaaacaccgtttataattttgtactgttttactttaagtaaggatgcaaaaaatagcaggactcagctaagttctaagccctggaggttatattaaataaaagagaaatggaataaaaactgtaaaaaaaaaaaaaaaaaaaaaaaaaaaaaaaacaaaaaaaaaaacaaaaaaaaaaaagaaagagagacgacgaaacaaaaaaaactatgaaagaaaggacccaaacaatagtaaaggaaaccatacattatcgtggcagaactaggggcgacatcaaaggggcaaactcgtaaagtaaagcacgaagggtcccggcggcacgaacacaacaccgctccagctagtgaacaacaagacgaagactgagagacgcaggtcggcaacacaaacatcaactaatattgagagagcggaaacccaatactagtggcacgcactacagaccacataaacaatatagtccatacgaaccactctcgactgtaggaactgaatcaacaaaaacaaattaatttgacagatcgtgcattaaaaggtggcgtgacaacaacctgtacgcctgcaatgagcagcaaactacggcaggacgaacatagattcggcacatctcgaaaggcgcatagtgtagactacaagaagtaaaaactattatttacaagcaccgacgatatctgtattaaaattaaacactcactacacacatacttagaacaaacgacgtcaacgaacacagcaagccgacagctacttgtatagctagatactgaacgccagacgctg

SEQ ID NO: 444767 - DNA, 3744 bp, Homo sapiens
ggaatgagagaaagaggctccggggagatagcggaccagtgagggctgcccctcttttgaagcggttttcgtctctttccgccagtggcctcccagctcacgcaggggcgggtcccggtagcgcgaggcggtgcagggcgggaaggggagtggtggcggctgcggcagtagggacagcaggagcagtggtgctgtcagcgcggccgtcggagacatgggagacccggggtcggaagtgagtagtcgagtgagggtcctggcgttctcagaggcgaaccgcgaagggtttgtgttttctgcggtctgaggcctggtgctccgtcgcagcctcggggcgatacctcttcagtgtcttgggccgagcccagctctggggcctgataatagaatctgtccctccagctggccctgaggcatctgagtcaacaacggatgaaaatgaagacgacattcagtttgtcagtgaaggaccatcgagacctgttcttgaatacatcgatctggtctgtggtgatgatgaaaaccctagcgcctattatagtgatattctgtttcctaaaatgccaaaacgacagggtgattttttgcattttttaaatgtgaagaaggtgaaaacagacacagaaaataatgaagtgagcaaaaatcactgcagattgtctaaggcaaaggaaccacatttcgagtatattgaacaaccaatcattgaagaaaagccatcactttcatcaaagaaagaaatagataatcttgtgcttccagattgttggaatgaaaaacaagcatttatgtttacagaacaatacaaatggcttgaaataaaagaaggtaaattaggatgtaaggattgttcagcagttcggcatttgggatcgaaagcagaaaagcatgtccatgtgtccaaggaatggattgcatatttagtaacccctaatggcagtaataaaactactaggcaagcttctctacgaaaaaaaattagggaacatgatgtttctaaagcccatggtaaaattcaggatttgttaaaggaatcaactaatgattcaatttgtaatttagtgcataaacaaaataataaaaatattgatgctactgtaaaagttttcaatactgtttacagtttagtaaaacataacagacctttatctgatattgagggggcaagagaattacaggaaaaaaatggagaggtaaattgtttaaatacacgttacagtgcaacaagaatagcagaacatattgcaaaagaaatgaagatgaagatatttaagaatattatagaagagaatgccaaaatctgtatcataattgatgaggcatctacagtttcaaagaaaaccaccctagtgatttatctccagtgcacaattcagtcagctcctgcacctgttatgttatttgtggctttaaaagaattggtgtcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgtcacttgatgattctatatccgaaataaaacaaattaatcatttaaaaatatttattgataaaatttattctatttatcatcaacctaataaaaatcaaaccaagcttctaggaactgtagctaaagaacttgaaactgaaattattaaaattggtcgagtaatgggaccaagatgggcggcatgtagtttacaagctgctactgctgtatggcatgcatatcctatattatatatgcatttttctcattcttactctggtttggcgaagagattagctaacattaatttcttacaagaccttgctttaatgattgacattcttgaagaattttcagtactttcaactgcattacagtcaagatcaactaatattaagaaagcacaaaaattgatcaaacgtaccataagagctttggaaaatttaaaaattggtactggaaagtatgaatctcaaattgaagatttgatcaagtcagataagtttaaagatattccatttaataaaaacaataaatttaatgctcttcctaggagtatattactagacaatataattcagcacatgaacctacgccttttatctgacagaaaccatgaagatatttttaattactttgatttgctggaaccttccacatggccttatgaagaaataacttcaccatggatagctggtgaaaaaacattatttcatttgtgtaaaattttaaaatatgaagttgatttgaatgattttcgggaatttgtaaataataatataaaatcaaacaatgtttcaattcctacaactatatacaaagctaaaaagatagttagcaccattgcaatcaatagtgctgaagctgaaaggggtttcaatttaatgaacataatttgtacaagggtgagaaatagtttaacaatagatcatgtatcagatttaatgacaataaatttactggggaaagaattagcagattgggatgcaacaccgtttgtaaaatcttggtcaaattgcaaccacaggttggctacagatacaagagttcggcaaaagtcaacaaaagtcttccatgagaatcaattggctatatggaacttaaaatagaatattgtatacgttttttgtcatctgtaaattatgtactacacatcctttatatacataaaggtctttttttttttttggaaagccagttaaacttttatcagcatgttgctgtttaaaaggcgttctttaagaagataatcttgaagattggttttagaagctatagttttttagagattggcccatgtttgctagagtgggtcataatacatattccatgaagttctgtacagaacaaacaccgtttataattttgtactgttttactttaagtaaggatgcaaaaaatagcaggactcagctaagttctaagccctggaggttatattaaataaaagagaaatggaataaaaactgtaaaaaaaaaaaaaaaaaaaaaaaaaaaaaaaacaaaaaaaaaaacaaaaaaaaaaaagaaagagagacgacgaaacaaaaaaaactatgaaagaaaggacccaaacaatagtaaaggaaaccatacattatcgtggcagaactaggggcgacatcaaaggggcaaactcgtaaagtaaagcacgaagggtcccggcggcacgaacacaacaccgctccagctagtgaacaacaagacgaagactgagagacgcaggtcggcaacacaaacatcaactaatattgagagagcggaaacccaatactagtggcacgcactacagaccacataaacaatatagtccatacgaaccactctcgactgtaggaactgaatcaacaaaaacaaattaatttgacagatcgtgcattaaaaggtggcgtgacaacaacctgtacgcctgcaatgagcagcaaactacggcaggacgaacatagattcggcacatctcgaaaggcgcatagtgtagactacaagaagtaaaaactattatttacaagcaccgacgatatctgtattaaaattaaacactcactacacacatacttagaacaaacgacgtcaacgaacacagcaagccgacagctacttgtatagctagatactgaacgccagacgctg

SEQ ID NO: 444768 - DNA, 675 bp, Homo sapiens
atttgtacaagggtgagaaatagtttaacaatagatcatgtatcagatttaatgacaataaatttactggggaaagaattagcagattgggatgcaacaccgtttgtaaaatcttggtcaaattgcaaccacaggttggctacagatacaagagttcggcaaaagtcaacaaaagtcttccatgagaatcaattggctatatggaacttaaaatagaatattgtatacgttttttgtcatctgtaaattatgtactacacatcctttatatacataaaggtctttttttttttttggaaagccagttaaacttttatcagcatgttgctgtttaaaaggcgttctttaagaagataatcttgaagattggttttagaagctatagttttttagagattggcccatgtttgctagagtgggtcataatacatattccatgaagttctgtacagaacaaacaccgtttataattttgtactgttttactttaagtaaggatgcaaaaaatagcaggactcagctaagttctaagccctggaggttatattaaataaaagagaaatggaataaaaactgtaagccttttggctcttgtctttctcatttccatatctgtgctatctagtatggtagccactagctacatgtggctgatcagcttagggctaaaagtaa

SEQ ID NO: 444769 - DNA, 1533 bp, Homo sapiens
ggaatgagagaaagaggctccggggagatagcggaccagtgagggctgcccctcttttgaagcggttttcgtctctttccgccagtggcctcccagctcacgcaggggcgggtcccggtagcgcgaggcggtgcagggcgggaaggggagtggtggcggctgcggcagtagggacagcaggagcagtggtgctgtcagcgcggccgtcggagacatgggagacccggggtcggaaataatagaatctgtccctccagctggccctgaggcatctgagtcaacaacggatgaaaatgaagacgacattcagtttgtcagtgaaggaccatcgagacctgttcttgaatacatcgatctggtctgtggtgatgatgaaaaccctagcgcctattatagtgatattctgtttcctaaaatgccaaaacgacagggtgattttttgcattttttaaatgtgaagaaggtgaaaacagacacagaaaataatgaagtgagcaaaaatcactgcagattgtctaaggcaaaggaaccacatttcgagtatattgaacaaccaatcattgaagaaaagccatcactttcatcaaagaaagaaatagataatcttgtgcttccagattgttggaatgaaaaacaagcatttatgtttacagaacaatacaaatggcttgaaataaaagaaggtaaattaggatgtaaggattgttcagcagttcggcatttgggatcgaaagcagaaaagcatgtccatgtgtccaaggaatggattgcatatttagtaacccctaatggcagtaataaaactactaggcaagcttctctacgaaaaaaaattagggaacatgatgtttctaaagcccatggtaaaattcaggatttgttaaaggaatcaactaatgattcaatttgtaatttagtgcataaacaaaataataaaaatattgatgctactgtaaaagttttcaatactgtttacagtttagtaaaacataacagacctttatctgatattgagggggcaagagaattacaggaaaaaaatggagaggtaaattgtttaaatacacgttacagtgcaacaagaatagcagaacatattgcaaaagaaatgaagatgaagatatttaagaatattatagaagagaatgccaaaatctgtatcataattgatgaggcatctacagtttcaaagaaaaccaccctagtgatttatctccagtgcacaattcagtcagctcctgcacctgttatgttatttgtggctttaaaagaattggtgtcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgtcacttgatgattctatatccgaaataaaacaaattaatcattt

SEQ ID NO: 444770 - DNA, 3577 bp, Homo sapiens
ggaatgagagaaagaggctccggggagatagcggaccagtgagggctgcccctcttttgaagcggttttcgtctctttccgccagtggcctcccagctcacgcaggggcgggtcccggtagcgcgaggcggtgcagggcgggaaggggagtggtggcggctgcggcagtagggacagcaggagcagtggtgctgtcagcgcggccgtcggagacatgggagacccggggtcggaactggccctgaggcatctgagtcaacaacggatgaaaatgaagacgacattcagtttgtcagtgaaggaccatcgagacctgttcttgaatacatcgatctggtctgtggtgatgatgaaaaccctagcgcctattatagtgatattctgtttcctaaaatgccaaaacgacagggtgattttttgcattttttaaatgtgaagaaggtgaaaacagacacagaaaataatgaagtgagcaaaaatcactgcagattgtctaaggcaaaggaaccacatttcgagtatattgaacaaccaatcattgaagaaaagccatcactttcatcaaagaaagaaatagataatcttgtgcttccagattgttggaatgaaaaacaagcatttatgtttacagaacaatacaaatggcttgaaataaaagaaggtaaattaggatgtaaggattgttcagcagttcggcatttgggatcgaaagcagaaaagcatgtccatgtgtccaaggaatggattgcatatttagtaacccctaatggcagtaataaaactactaggcaagcttctctacgaaaaaaaattagggaacatgatgtttctaaagcccatggtaaaattcaggatttgttaaaggaatcaactaatgattcaatttgtaatttagtgcataaacaaaataataaaaatattgatgctactgtaaaagttttcaatactgtttacagtttagtaaaacataacagacctttatctgatattgagggggcaagagaattacaggaaaaaaatggagaggtaaattgtttaaatacacgttacagtgcaacaagaatagcagaacatattgcaaaagaaatgaagatgaagatatttaagaatattatagaagagaatgccaaaatctgtatcataattgatgaggcatctacagtttcaaagaaaaccaccctagtgatttatctccagtgcacaattcagtcagctcctgcacctgttatgttatttgtggctttaaaagaattggtgtcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgtcacttgatgattctatatccgaaataaaacaaattaatcatttaaaaatatttattgataaaatttattctatttatcatcaacctaataaaaatcaaaccaagcttctaggaactgtagctaaagaacttgaaactgaaattattaaaattggtcgagtaatgggaccaagatgggcggcatgtagtttacaagctgctactgctgtatggcatgcatatcctatattatatatgcatttttctcattcttactctggtttggcgaagagattagctaacattaatttcttacaagaccttgctttaatgattgacattcttgaagaattttcagtactttcaactgcattacagtcaagatcaactaatattaagaaagcacaaaaattgatcaaacgtaccataagagctttggaaaatttaaaaattggtactggaaagtatgaatctcaaattgaagatttgatcaagtcagataagtttaaagatattccatttaataaaaacaataaatttaatgctcttcctaggagtatattactagacaatataattcagcacatgaacctacgccttttatctgacagaaaccatgaagatatttttaattactttgatttgctggaaccttccacatggccttatgaagaaataacttcaccatggatagctggtgaaaaaacattatttcatttgtgtaaaattttaaaatatgaagttgatttgaatgattttcgggaatttgtaaataataatataaaatcaaacaatgtttcaattcctacaactatatacaaagctaaaaagatagttagcaccattgcaatcaatagtgctgaagctgaaaggggtttcaatttaatgaacataatttgtacaagggtgagaaatagtttaacaatagatcatgtatcagatttaatgacaataaatttactggggaaagaattagcagattgggatgcaacaccgtttgtaaaatcttggtcaaattgcaaccacaggttggctacagatacaagagttcggcaaaagtcaacaaaagtcttccatgagaatcaattggctatatggaacttaaaatagaatattgtatacgttttttgtcatctgtaaattatgtactacacatcctttatatacataaaggtctttttttttttttggaaagccagttaaacttttatcagcatgttgctgtttaaaaggcgttctttaagaagataatcttgaagattggttttagaagctatagttttttagagattggcccatgtttgctagagtgggtcataatacatattccatgaagttctgtacagaacaaacaccgtttataattttgtactgttttactttaagtaaggatgcaaaaaatagcaggactcagctaagttctaagccctggaggttatattaaataaaagagaaatggaataaaaactgtaaaaaaaaaaaaaaaaaaaaaaaaaaaaaaaacaaaaaaaaaaacaaaaaaaaaaaagaaagagagacgacgaaacaaaaaaaactatgaaagaaaggacccaaacaatagtaaaggaaaccatacattatcgtggcagaactaggggcgacatcaaaggggcaaactcgtaaagtaaagcacgaagggtcccggcggcacgaacacaacaccgctccagctagtgaacaacaagacgaagactgagagacgcaggtcggcaacacaaacatcaactaatattgagagagcggaaacccaatactagtggcacgcactacagaccacataaacaatatagtccatacgaaccactctcgactgtaggaactgaatcaacaaaaacaaattaatttgacagatcgtgcattaaaaggtggcgtgacaacaacctgtacgcctgcaatgagcagcaaactacggcaggacgaacatagattcggcacatctcgaaaggcgcatagtgtagactacaagaagtaaaaactattatttacaagcaccgacgatatctgtattaaaattaaacactcactacacacatacttagaacaaacgacgtcaacgaacacagcaagccgacagctacttgtatagctagatactgaacgccagacgctg

SEQ ID NO: 444771 - DNA, 2438 bp, Homo sapiens
  misc_feature (2)..(2): n is a, c, g, or t
  misc_feature (7)..(8): n is a, c, g, or t
gncacgnngtcgccttgtgcgcttgcgcgcgtccaggcgctcccgtgaggcagtgcgaggcgcgcggggcacggagggcggtggcggcgggctcctgcgagaagcaagcggaacttcctgagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacggaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaa

SEQ ID NO: 444772 - DNA, 698 bp, Homo sapiens
aggcagtgcgaggcgcgcggggcacggagggcggtggcggcgggctcctgcgagaagcaagcggaacttcctgaggtgactgacgcgggcctcggttctgggcgcaggggtgtggggctggaggagtggccgcgatccccgtctgcacccaggtgcctcttttttttcctgcgctcctgggggctccttccaggtgctccagcagctgcccggggatcagggcccggtccgctgggcgaggagctggggcgggggctgtgcggggcctgtcacccccgtcttctgcagctcggtgtcgacggcgattcggtgggcttgtgcgtttgttttgtcagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggtaaatatttagttgatcttcagaagatgtgccatgcttatttgcgtcttcttacgtacggagggcagggaagagaggctgcctagcctcct

SEQ ID NO: 444773 - DNA, 2384 bp, Homo sapiens
  misc_feature (2)..(2): n is a, c, g, or t
  misc_feature (7)..(8): n is a, c, g, or t
gncacgnngtcgccttgtgcgcttgcgcgcgtccaggcgctcccgtgaggcagtgcgaggcgcgcggggcacggagggcggtggcggcgggctcctgcgagaagcaagcggaacttcctgagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaagaatatttctttagtacaagatcagttggcagtatctgctcaagaacattctttctttctgtccaaacggaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaa

SEQ ID NO: 444774 - DNA, 1413 bp, Homo sapiens
cccacgcgtccgaaacattgctgctgatatgtttcatgtcttgtacacagttcatgtgtttcttcctactgtttctggtaagaagccactatgaataaaaagcaccaataaaacatcatacatgataatattgtagaacaccactgtccctaggacaatgtagagatgccaagtacacactgcttaaatcagaacaaggggggaaaagcatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444775 - DNA, 271 bp, Homo sapiens
attgtccccagcccccagatcagttcaagaagacgtcactgctgggacacacaggctgagttgtgccagctcattgccagctgagagtttcttttctctccccctcgctttggagtacattgtaagaatcttaaaaaaaaaaaaaaaaaaaaaaaaaaatcagagccctgaaatagtttggggcccttgggggcttccttttataaacaccccccccatttccctaagaaaaagtggcaagggaaaaacagcacaacgccaccaacatgcg

SEQ ID NO: 444776 - DNA, 6394 bp, Homo sapiens
actcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaaatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444777 - DNA, 6855 bp, Homo sapiens
actcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaattctctcaggccaggcacaccacagccctttgaaacgatctgtgtcccttaccccacccatgaatgtgccaaaccagcctctaggacatggatggatgtctcatgaggacttacgagctagaggaccccagtgcctcccatccgatcatgcccccctgtctccacaaagcagtgtagcctcttcaggaagtggtgggagtgaacacttagaagatcagaccactgctcgtaacacattccaagaagaaggtagtgggatgaaagatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggaggtacaccagacctttctcctgaaggtggaaccaggtggcaccctgcttatctcctccttgtcaccaacataaccctttatcgcctgcagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444778 - DNA, 6766 bp, Homo sapiens
actcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaattctctcaggccaggcacaccacagccctttgaaacgatctgtgtcccttaccccacccatgaatgtgccaaaccagcctctaggacatggatggatgtctcatgaggacttacgagctagaggaccccagtgcctcccatccgatcatgcccccctgtctccacaaagcagtgtagcctcttcaggaagtggtgggagtgaacacttagaagatcagaccactgctcgtaacacattccaagaagaaggtagtgggatgaaagatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444779 - DNA, 5654 bp, Homo sapiens
atcagtggtggctgtctgagttctgtgtgcagagctcttttgttcagttactgaacccttatcaagcagctgcctgggactcaatttgccccatccattggagattaaccgacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggaggtacaccagacctttctcctgaaggtggaaccaggtggcaccctgcttatctcctccttgtcaccaacataaccctttatcgcctgcagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444780 - DNA, 7064 bp, Homo sapiens
actcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaaatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaccaaagaggggggcgcgggccgcacaattacttatctctcccacgcgagggcagcggcacaaactactcgcaccacccgaacttttatatagaagagagagccggaccaccaccaagtagtgaaggtagtgtattaaaaaacaagaacacgagccgcggggcttgtaaacataaaacgcgtcgagggaggaagaacccctggctacactgacgctagtcagtgagagacgacaactatggggtgggggtagacatacgacgagggaagccacccacccaaagaagagaacagtacacgccgcctcagcggcacgactaaacacacatcgccaaggtgagacaggggtgaggcaccaccaagcacgaatgtagctggccgccggagtaaaaaaagcagtgcccaaagagcgaaattaatacatcagaacacaaaaaaaaaccagccggacaggagtaggacaagaacaaagcatcatcaaaaccatcgaccacagccacagccccacaaccaaacccacccgcgcccaaccggcagcaccaaaccccaagcaccgccccccaaccccacccac

SEQ ID NO: 444781 - DNA, 5302 bp, Homo sapiens
ttttaattatagttatttgctggcacacagctccctgtaggcttcataactgtcaaaatgtgagcagaggcggggtgcagtggctcacgcctgtaatcccagcactttgagaggccgaggcaggaggatcacttgagctcaggagttccagaccagcctgggcaacatggtagaccctgtctccaccaaaaatataaaaatctgtagtcccaactactcaagaggctgagttgggaagatcgcttgagcctgaaaagttgagaccagcctgggcgacatagtgagactccatctctaccaaaaaaaaaaaaaaaaaaaaaaaaaatcagagccctgaaatagtttgtgctcttcgttgcatacatttatagaactcccccatttcctagaaaagtggcagggaaaaagcaaaagcaacaaatgcgataaaaagagttctgcagatagggaaagaggtgtccagatgaagctgaggcttacagcaaggccaccactgaggaggtgaagagaaattacagtgaatggaatctaaaccctctctctataaataagcagatgctagcactggcctgcaagccccttttctagaagttagagttctcctgggatctttgcctcccaaattcttgctggcggctctgctctccaccccagtggggctgaactaacaagttccccttttgcttttctcaccagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444782 - DNA, 4595 bp, Homo sapiens
cgctggagggttctgagcagaggaggcacagactgtgacatgaccagctatttttagtctccgttttgttccaggttcccaagttcacagtggactgtgtttaacagaccttagagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444783 - DNA, 3465 bp, Homo sapiens
actcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaaatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaagcggctgtgcagacattcaattgttattattata

SEQ ID NO: 444784 - DNA, 1149 bp, Homo sapiens
actcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaagtaagttccccggaatccctttaacgtagtctggtttggcgatttgctgtgtatgtggcatgtcctgctgacagtgtctgctccatgcaccctgtgaccctgggagagaaggactgattggaattggctgtgggaaagagtcctttggaccccatatttgttgctctttgactctgcaaagatgaaaatacttgggaaggtaaaagtgactgatggtccaaatttgggttataaacagaccaaaaataaatagacaataaatgaaagaaggaaacttgccgtttccacaatcagaaatg

SEQ ID NO: 444785 - DNA, 6521 bp, Homo sapiens
gatgtttcgcgaccaggtcggggtgctggcgggctggtttaagggctggaacgagtgcgagcagactgttgcgctgctgtcgctgctcaagcgcgtgagccagacccaggcccgcttcctccagctctgcctggagcactcgctggccgactgcgccgagctgcacgtcctcgaacgcgaggccaacagccccggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaattctctcaggccaggcacaccacagccctttgaaacgatctgtgtcccttaccccacccatgaatgtgccaaaccagcctctaggacatggatggatgtctcatgaggacttacgagctagaggaccccagtgcctcccatccgatcatgcccccctgtctccacaaagcagtgtagcctcttcaggaagtggtgggagtgaacacttagaagatcagaccactgctcgtaacacattccaagaagaaggtagtgggatgaaagatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444786 - DNA, 3746 bp, Homo sapiens
actcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaaatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444787 - DNA, 5595 bp, Homo sapiens
atacgctaggtacgaggccgggtgggcaaatctctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggaggtacaccagacctttctcctgaaggtggaaccaggtggcaccctgcttatctcctccttgtcaccaacataaccctttatcgcctgcagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444788 - DNA, 5175 bp, Homo sapiens
agatctcactactgcactccaacctgggtaacagagtgagaccctgactcaaaaaaaaaaaaaaaaaaaaaatgaggagacctccaaggcgacatcccttgggaagcctgtggcttaaaaagggctgaataacgactgatattctcttccttctctcttggctctcacagtcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggaggtacaccagacctttctcctgaaggtggaaccaggtggcaccctgcttatctcctccttgtcaccaacataaccctttatcgcctgcagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctggggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaa

SEQ ID NO: 444789 - DNA, 2851 bp, Homo sapiens
  misc_feature (2739)..(2739): n is a, c, g, or t
actcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaaatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaagcctgctaaacaaaccaagtgagatgcacagagttatacaatgaagaagagctttttagagagggaaagagagaaagaaaggtcagactaggatttaacttgggtctaagagcagcagagcccttccaccttctgatcctgangcagtgagaccctcttattctagtgaagaccataactcactgctgtaagaaaaagaccctgttttatggaggcagggactatagataagctgatttctgaaggacccagctg

SEQ ID NO: 444790 - DNA, 1187 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttcttatatataagaacaat

SEQ ID NO: 444791 - DNA, 1120 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444792 - DNA, 982 bp, Homo sapiens
acgcggttccccagtctactaggcggcttttataccccgccgctccgggatagtccttcaacatctaaattccagtttagaatgtaggcagcaaatgccggtaagaagctgaccgctcgaaattgatgggatttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444793 - DNA, 557 bp, Homo sapiens
  misc_feature (38)..(38): n is a, c, g, or t
  misc_feature (59)..(59): n is a, c, g, or t
gcgccctggattactaattctggggattgattgaggcnccctcctctttaataaattcnggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444794 - DNA, 872 bp, Homo sapiens
  misc_feature (38)..(38): n is a, c, g, or t
  misc_feature (59)..(59): n is a, c, g, or t
gcgccctggattactaattctggggattgattgaggcnccctcctctttaataaattcnggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaaaaaacaaaaaacaacacaacaacaacaaagaacagaaagcaaaaaaagaggcgaacaaagggacaaccagcacacgaagcaaggatgcaaaaaaaaaagagggtacgggcttattcattacatccacgaggaacagctatcagaaagcgaacgatagttagtaagagagacacgatagaggatgaattaaaggagggggcctataatactacggtggtgaaaacaagagtactagtgaggaaccatggggggaaaagaacaccacatgatagtggaaaacaacagggtatgacacaatcttgggtagaaggctt

SEQ ID NO: 444795 - DNA, 1304 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaaaaaaaaaaaaagggggggggcaaaagaatcctcgggggggcaattaagggtacccgttttggccaaggggcccaaggaggggataaaaaaaaggaggggggttaaacgggggagggaaacggctgggcttggaaaggaaccttcgg

SEQ ID NO: 444796 - DNA, 1375 bp, Homo sapiens
  misc_feature (1206)..(1206): n is a, c, g, or t
  misc_feature (1225)..(1225): n is a, c, g, or t
  misc_feature (1249)..(1249): n is a, c, g, or t
  misc_feature (1253)..(1254): n is a, c, g, or t
  misc_feature (1256)..(1257): n is a, c, g, or t
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaaaaaaaaaaaaaaaaaaaaaaaaaaaaaaaaaaaaaaaaaaaaaaaaanaaaaaaaaaaaaaaaaaanaaaaaaaaaaaaaaaaaaaaaaanaaannanntttctttttattattgaaaaatttttttgtggggcgccaaatttgggctccattgcaaatttccctttttggggggtgttataaaaacagggcggggtttaaacaagggtggagggga

SEQ ID NO: 444797 - DNA, 1805 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagcagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaatataacaggcaaaataacattatcatgaaaatagttttgacctcatgaaccccatgaaaggttccccagaccaaaattttagaatcactggtatagggtaacactttattgtgtaaattcagttctctgtaccccacttaaatatgtattattatctcttgacattattttcccaaaaaatgctgtttgatttcttacttgttctgtactttgtttttcaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444798 - DNA, 1134 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagagaggatacttcaaccagctgattttgcgttatagactaccgctcgccttagctacctgcaagaaactgtataactctagagttacgtattactggccgtcctgtatactcagaacagcta

SEQ ID NO: 444799 - DNA, 1133 bp, Homo sapiens
  misc_feature (23)..(24): n is a, c, g, or t
aattcgcggccgcgtcgacagannacagaagggggagccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444800 - DNA, 982 bp, Homo sapiens
  misc_feature (821)..(821): n is a, c, g, or t
  misc_feature (832)..(832): n is a, c, g, or t
  misc_feature (835)..(835): n is a, c, g, or t
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaaaattctctatacctctgagggtcccctatgggcgaggccgggnaacctggcatnccnagctcggatttgaatggtggtacgccgcgcggccaagggggaatcggggcgtagaaaacccacagaaaaaacactgctttgtctcaccgctttcgacgttctaaaaaacaacctcttctgctcttcgctcccgtcccacacaacacc

SEQ ID NO: 444801 - DNA, 842 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaatactttggcctatttactactctttgggggtcacccccttgggggcccagggcccggattgccc

SEQ ID NO: 444802 - DNA, 860 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacaagatgaatttttatgacaaattggtgctgaccggctgcaaaataccatacaactcgcccttatttattatttttggagggatccccccttgttagccaagtgcccggataacgccttggccattgcacccgg

SEQ ID NO: 444803 - DNA, 1122 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatgtcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444804 - DNA, 1110 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444805 - DNA, 1129 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttatagttcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444806 - DNA, 1061 bp, Homo sapiens
gcacgagggcatattttgctgccgctaccattttcatagacttggtaattttctggatgtttttgatggactttagtctcctggtgatatctttcaaagttgccatatttcgaacttgaatccattgcggctgcaaggtccaggccgacagcccagcgacacccgcgctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444807 - DNA, 990 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatgctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444808 - DNA, 714 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgccctccgattcacttcctgcatatgaatactgacgaatgttccatctctctccattaatttccggccctgtcttcccctatacatctctacgccatcgctccactcttcccctttccg

SEQ ID NO: 444809 - DNA, 575 bp, Homo sapiens
  misc_feature (523)..(524): n is a, c, g, or t
  misc_feature (543)..(544): n is a, c, g, or t
  misc_feature (546)..(546): n is a, c, g, or t
  misc_feature (548)..(548): n is a, c, g, or t
  misc_feature (571)..(571): n is a, c, g, or t
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttatagactcatnngaccatttcggtggcatcnngngnaggcccccacttggagagcgtcntctg

SEQ ID NO: 444810 - DNA, 872 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggtaatttaaatatatattgtttattttcataaagatgtaagcacgaataaatcttctctcaaaagttttgacaaactctcaaaaccttcatcaataacaaggtatattcttcagggccttttttggtatattcacaagggggtgtttgtttcctttttcttttttccaggatatattggaacatttctgttttccttcccctgttttctacctttgcttcttcatccggatcataagttgaatgccatgtgaatatcaaaagctatcagcattaagccaaatgaggcatctgaggagctgttacagcctggaaatgttagcaatagttcattaggattagaaggagaggaataaag

SEQ ID NO: 444811 - DNA, 1249 bp, Homo sapiens
ctgacattgaggcccgaggataccttgacccccgaggaggtttccctgagctgagatcaccccccctccctcccccctgggccaccgaaccagactccctctcccaaaaaaaaaaaacctctaaatatattgtgttaatttatagaaaaattgtaatttaaattacatattcatagtcttgcctacttgcatgagcatgtttttattgcttctaacctggattgaaatctatgactttttataacagtcattgagtctgtttcaaaggaatcttgtggtaagtatttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagcagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaatataacaggcaaaataacattatcatgaaaatagttttgacctcatgaaccccatgaaaggttccccagaccaaaattttagaatcactggtatagggtaacactttattgtgtaaattcagttctctgtaccccacttaaatatgtattattatctcttgacattattttcccaaaaaatgctgtttgatttcttacttgttctgtactttgtttttcaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444812 - DNA, 793 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatgtcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagctgagtattatgacctattctttgaggagcccccctagtgacaaatgccggatgccgcctgggcaatgccgcaggatgctctggatgattgacaatgga

SEQ ID NO: 444813 - DNA, 427 bp, Homo sapiens
ctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagccatggacaatgccagcaagaatgcttctgagatgattgacaaattgacattgacattcaaccgtacccgccaagctgtcatcacaaaagagttgattgaaattatctctggtgctgcagctctgtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444814 - DNA, 921 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatagtaagtatgttgtttgtctcaatatgtgaattgagaaaaactaaattttgacaaatacaaatactttcaaaaatatactgctttagcccgttgtgtatttgatcaaaactgaccaaatggatttccattgtatgtttgggacattggacttgttctgaaaagaccagtaagaaaggacacctgagacagctatgttctgttgtttgtagaatgatcatgatataactagaaaaaattataccagtgttggtgtaggtgggtgtatgtgtgggaaggggtaaatcatgttatatataaataatgttatggaatatgtggttaaggcaactttcaataccatttaatgttttaaatgtatattattgtcttatgttgccatttgcttgtcctaagtagtagctagttttgccttccttttattagtactatttctttttttttttttttggagatggagcctcattctatcacccaggctggagtgcagtggcgccatctcggctcactgcaagctccgcctcccgggttcacgccgttctcctgcctcagcctcccgagtagctgggactacaggcgcccgccaccacgctcggctaattttttgtatttttagtggagacggggtttcaccgtgttagccaagatggtcttgatctcctgacctcatgatccgcccacctcagcctcccaaagtgctgggattacaggcgtgagccaccgcgcccggctattagtactagtt

SEQ ID NO: 444815 - DNA, 479 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatttttggagatggagcctcattctatcacccaggctggagtgcagtggcgccatctcggctcactgcaagctccgcctcccgggttcacgccgttctcctgcctcagcctcccgagtagctgggactacaggcgcccgccaccacgctcggctaattttttgtatttttagtggagacggggtttcaccgtgttagccaagatggtcttgatctcctgacctcatgatccgcccacctcagcctcccaaagtgctgggattacaggcgtgagccaccgcgcccggctattagtactagtt

SEQ ID NO: 444816 - DNA, 267 bp, Homo sapiens
ctactaagggatttaaatatatgtctattcatatacattctgagtcctgtatttgatagattgtttctttatggggtattctttaaataaatatatattaactgaaagtttttcttgtataatggaactatttttcaaaaaactgaaacatttttaaaacttttatcctcaggattcaagttcgaaatatggcaactttgaaagatagtaagtatgttgtttgtctcaatatgtgaattgagaaaaactaaattttgacaaatacaa

SEQ ID NO: 444817 - DNA, 1157 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444818 - DNA, 958 bp, Homo sapiens
  misc_feature (23)..(24): n is a, c, g, or t
  misc_feature (797)..(797): n is a, c, g, or t
  misc_feature (808)..(808): n is a, c, g, or t
  misc_feature (811)..(811): n is a, c, g, or t
aattcgcggccgcgtcgacagannacagaagggggagccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaaaattctctatacctctgagggtcccctatgggcgaggccgggnaacctggcatnccnagctcggatttgaatggtggtacgccgcgcggccaagggggaatcggggcgtagaaaacccacagaaaaaacactgctttgtctcaccgctttcgacgttctaaaaaacaacctcttctgctcttcgctcccgtcccacacaacacc

SEQ ID NO: 444819 - DNA, 1253 bp, Homo sapiens
  misc_feature (1159)..(1159): n is a, c, g, or t
  misc_feature (1161)..(1161): n is a, c, g, or t
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaacnanaaccacaacccaccaccaccccccacccactccaccccccccccccactccccccccaacccaaaaacgcggccccccctcataaacctccg

SEQ ID NO: 444820 - DNA, 1096 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgtaaagaaggaaaattcagccagttgattttgtttttagcttactgctgcctttgtccgaagaaactggctctgagcgggaaactggctctgagcgggagaaactgggtctgagcggc

SEQ ID NO: 444821 - DNA, 1309 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgtgagtaattgtagattgtcgccttcagagaattttttttcctcttgctgtgtctgcttgtttggatgcttaaaagtttttcgtttttttcttttgaagttgaaactcattgctgaaacttgcatcctaactcttaggctataaagatgtggtaaaaatgggacctctttgctttatttttattgtttcagctggaaacactcgggcttagttttcggttttctaaaggattaggaatgggatgtggataattcagtatcatttatgaaatctttttttggaatttaaacaattgtaagccaagctttctgagttacagggctagtttcag

SEQ ID NO: 444822 - DNA, 1115 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaatccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444823 - DNA, 1118 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444824 - DNA, 828 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagctgagtattatgacctattctttgaggagcccccctagtgacaaatgccggatgccgcctgggcaatgccgcaggatgctctggatgattgacaatgga

SEQ ID NO: 444825 - DNA, 1103 bp, Homo sapiens
  misc_feature (5)..(5): n is a, c, g, or t
  misc_feature (13)..(13): n is a, c, g, or t
  misc_feature (15)..(16): n is a, c, g, or t
  misc_feature (19)..(20): n is a, c, g, or t
  misc_feature (87)..(87): n is a, c, g, or t
aaganaaaaatangnnagnncgagccgggtgtgaatcggcacgagggcgcgggctgtcgctgagctgtcggctggacctgcagccgncatggattcaagttcgaaatatggcaacttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444826 - DNA, 1013 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaa

SEQ ID NO: 444827 - DNA, 806 bp, Homo sapiens
  misc_feature (750)..(750): n is a, c, g, or t
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcagtcttgcatctcctataagacagaaaagccatctttttcccttataccgttgcagtgctgcacacatgagtactattacgatttgtggtgngggccgaaaaataccaagcaattggccactttatacttttgaggggccccccttgg

SEQ ID NO: 444828 - DNA, 913 bp, Homo sapiens
  misc_feature (879)..(879): n is a, c, g, or t
  misc_feature (903)..(903): n is a, c, g, or t
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgatcaagttccatcctcagacaagagggtaagaaggttcaccagntgatttttgttttgctactgctgnctttgtccgg

SEQ ID NO: 444829 - DNA, 638 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagaccattcagcgaattgctacaatcttaccacgtgtacacgcagtctgcttgccgctttgtcgctcagagtaccccttataggactcatcttcccagctatcttaggcactcaatgacctcatcctaaagcctttcacatttctagatgggcctcttcttcacctggactccctccggttaattaatttaccaattcccgcttctttgcccg

SEQ ID NO: 444830 - DNA, 268 bp, Homo sapiens
agagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatgattcaagtaataggaaacaggaaaggtccaggacccgaagctgcaggaaagggaaagaccagactctagaacatttctgggacctacagcctaagtagatagactcagtgtacagccatttata

SEQ ID NO: 444831 - DNA, 1073 bp, Homo sapiens
gctcctcaagcgcggccagaatggacggcgaggccgaggaggcaccgagagcgagcgacgctgcgcgggctgccagcatgctgtcacctctcaatatgatcttataagaaagtagaggccatggagatacaatatctacttcacgggattttatgttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagtctttgaagttcttgccctattggcagttgaggatttagaacttgtgggggtatttactgaaggatcgtaattaccgaatcttgggaacaagggcccacatgttcccaaaggattccacggtccgggaagaccataaatgcacctccatacgggcaggattgcaaggatcacgggagccctactttaggcaccataaattttccgggagacaccctgttaaaaggcgaccttccaaccacggggaattctaaccaaggagagaaaactatatgcagcaagatatatataaaagaaggtgtggggattcaataaagtgagggcatgcaaagtaaacgaccaaataaagacaggggaaacaaaaccgagattaacatataaagcgggagcgagatacaaatccacaaaagagacattttcagacatcagagatgagtaatagagatgaaacaaaagtcgtgctgatatctttttagacttgctttttagtttta

SEQ ID NO: 444832 - DNA, 2843 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggaccttatacctgtgtgttgcttctgaagctcacttcaactccggctgatggaaatgctgtgtgcactgggcttagctgtttttggaaagtcctttaattttttctcttccacttggcagcttttcttagttctgggatgttggccactgtggtactgccagtaagaaatctggcctttttctgctccatttctctttgtttctaaggtcagttttaatttgtttgaattctgccagtttaggaaaatgactctgttttgtctttttaaatctgagcaagctttatgctgtagtcactaattatatttcagtaagaagcctttaaaaattgatgaatcagctattccaaaagtagaatatagtaatattcagcttttaaatttttaaaattttattttctgatagttgttactgctgtcattaaaaccagaagtgttagacactaacaggcaggtgcacaagaacttttctgtatgacttccaaaagacaagctgactaattcatgcaggcagcatatttgacattaataaatggccaagccattcctatttccaaggggttggcttctttcaagcagttcttacactgagacctttcttcagagagcttttctaggataacaaa

SEQ ID NO: 444833 - DNA, 1937 bp, Homo sapiens
aggcgccgcagagggtggagcttagcgaggaaatcctacaagcatctggaaacgaccattttcgtcaaactgcgggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444834 - DNA, 1914 bp, Homo sapiens
ttttggagcttcgctgagcctcctgggcgtagggttcccgggaaagtgtggagttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444835 - DNA, 2160 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaagggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444836 - DNA, 2178 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444837 - DNA, 2154 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444838 - DNA, 1294 bp, Homo sapiens
tgttctgtcagcatgaaaactactaggtttcttcccagcttaaagagcaactttaaaggatgctagatggagtctcactctgtcacccaagctagagtgcagtggtgtgatcatagcactggagcctggaactcctgactgaagcaatcctcccacctcagcttcctgagtagctgagactataggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444839 - DNA, 1115 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactgcgggtttgccgggttactgtggcccttccttttgcgccattacttctccggcctccacccttggcgactgtcctcccacccggcgaactggcctggtggccatcctaggcccaactttaaagcttgctgttggcatcagcgaggccccttgaaacccggtcttcaccgc

SEQ ID NO: 444840 - DNA, 2225 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444841 - DNA, 2824 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggaccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaacaaaaacaaaagcgaaaaaacggagaaagaaaacaaagaaaagaaccaagaagcagacaagccgagagagacgagacacacagcaaagcacaaccagaggacgggggacgcggggcggaggagcagcgcagaggcgcgagagagcgagcggcgcggggggcgggcagcgcgatgatgagtgagggggcgaggcgggggaatataggtgggagcagaggagaaggagccagagaggagagaggaggaggagaggaggcgtgggctacatgcgcgagtccgcaacagagataacacagcaaggacggggcggaggcagcgagcgagagaccatagcggcacagtcgaagaaagaaaagagacgaggacgcatgagacgagagggagaggtaggacgagacagggacgacgaggagtagaaggagaaggcgacgaaggtcggagcgacagagcgcgaaataagaggagagggcaccgtcagaggcgggtgtaac

SEQ ID NO: 444842 - DNA, 1957 bp, Homo sapiens
ttttggagcttcgctgagcctcctgggcgtagggttcccgggaaagtgtggagtgagccgcagcgccctggggtctggcggggtgactgaaagaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444843 - DNA, 2788 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagatagccatttcttttgtaccggatttaatgactttgaactgtgctgtaaataaataatacagctggaccttatacctgtgtgttgcttctgaagctcacttcaactccggctgatggaaatgctgtgtgcactgggcttagctgtttttggaaagtcctttaattttttctcttccacttggcagcttttcttagttctgggatgttggccactgtggtactgccagtaagaaatctggcctttttctgctccatttctctttgtttctaaggtcagttttaatttgtttgaattctgccagtttaggaaaatgactctgttttgtctttttaaatctgagcaagctttatgctgtagtcactaattatatttcagtaagaagcctttaaaaattgatgaatcagctattccaaaagtagaatatagtaatattcagcttttaaatttttaaaattttattttctgatagttgttactgctgtcattaaaaccagaagtgttagacactaacaggcaggtgcacaagaacttttctgtatgacttccaaaagacaagctgactaattcatgcaggcagcatatttgacattaataaatggccaagccattcctatttccaaggggttggcttctttcaagcagttcttacactgagacctttcttcagagagcttttctaggataacaaa

SEQ ID NO: 444844 - DNA, 2162 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaactggtaggatgtctggtgccaatccaggaagtgagagccatttcttttgtaccggatttaatgactttgaactgtgctgtaaataaataatacagctggacctta

SEQ ID NO: 444845 - DNA, 1616 bp, Homo sapiens
ccacaccccccccccccccccccccccccccccccccccgccccacccacactcacacgctagcgtacaggcccgcgtgttaactccgcgacgaggcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444846 - DNA, 1238 bp, Homo sapiens
taattttggaatcacatttcagctgcataacttctcaaatatttcagcataggctgctgtgcatgtagatagatatagtgaaataatgacataagatggaaaaatctcttccgtttgtcttggtgtttggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctta

SEQ ID NO: 444847 - DNA, 500 bp, Homo sapiens
  misc_feature (441)..(441): n is a, c, g, or t
  misc_feature (500)..(500): n is a, c, g, or t
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaatntgtaataacacggatcgaactatggagagtctctcccctttggtgacactccatcaggn

SEQ ID NO: 444848 - DNA, 382 bp, Homo sapiens
aagcttgcggccgcggccatggtcttcggaggggtgctgctggtggccaacattttgcggatactcttctggtttggaaggcgctttgagtccccgctgctgtggcagagcgccatcatgatcctgaccatgctgctgatgctgaagctgtgcaccgaggtccgtgtgcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtgg

SEQ ID NO: 444849 - DNA, 2501 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtgg

SEQ ID NO: 444850 - DNA, 2929 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444851 - DNA, 3458 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgaggctccttcctccaggatgtcggcaggaccctctctggaatgagggttagagtcctgcctgggcaggtgaacagagggcaaaaggtcagagagattctgttttctgaggcctaaagcaccccaacgtcatgacaagagctacagaagcactgtgggtacgggagcaccacgggtatgggagcaccacgggtacgggagcaccacgggtacgggagtcccgcagtgtggctggggacgggatgtcacaggcaccccatctccccatcgggccacaggaggcttggcctctgtccctgccgggagggccgggcagaagacgggcgacccacacagctggcacgttgtgagggcttggatggagtcctgaggctgagggagatggagcagtctctgcggaggaagtaggcagcgaggtcagccagcttcaagtgcgggaccgctgagaccctgtgcatcctcgtcaggaacggggaccaggagcagcagcgtcgggtcggctcggagtgatggagtgtgtggttgtagttacgcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444852 - DNA, 2795 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctgagtcttgctctgtcgccaggctggagtgcagtggtacaatctcggctcactgcagcctctgactcctgggttcaagtgattctcctgcctcagcctcctgagtagctgggactacaggtgcctgccaccatacccaggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444853 - DNA, 3013 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggtgctttgaatatgttattccactgccctctggactccattgtttctgatgagaagtcagctgttaatcttattggggtttccttacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444854 - DNA, 2950 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctgtccttactaccattttgcaaaaccagcattcagcagatcacactctgtggaatgccaacattcaggatttggcaggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444855 - DNA, 2707 bp, Homo sapiens
ctggaaccgtggatgaaaacccgtgtgtgtgggatgcggatacacttacacacatgtaaaatagtattgggggtgctgtgtgggcgagatgggagccggggtcatggtcctttgcctgcatacttctccttggctgcggaacttggaacgtgtctcagggatcccaggaggtgcaggtgttctacctctgagtttgccctgctccctgggtgagtgccaagcccctgtgagatcacctgggctaacttctgcttttataaaccgcagtgtggctggggacgggatgtcacaggcaccccatctccccatcgggccacaggaggcttggcctctgtccctgccgggagggccgggcagaagacgggcgacccacacagctggcacgttgtgagggcttggatggagtcctgaggctgagggagatggagcagtctctgcggaggaagtaggcagcgaggtcagccagcttcaagtgcgggaccgctgagaccctgtgcatcctcgtcaggaacggggaccaggagcagcagcgtcgggtcggctcggagtgatggagtgtgtggttgtagttacgcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444856 - DNA, 2511 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtgg

SEQ ID NO: 444857 - DNA, 991 bp, Homo sapiens
  misc_feature (20)..(20): n is a, c, g, or t
  misc_feature (25)..(25): n is a, c, g, or t
  misc_feature (27)..(27): n is a, c, g, or t
gggggcctgccgagatcccnttccntntggttcaagatgcacctcggaatgcaggctgcggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444858 - DNA, 2356 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatctttgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtgg

SEQ ID NO: 444859 - DNA, 1779 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtgg

SEQ ID NO: 444860 - DNA, 616 bp, Homo sapiens
  misc_feature (230)..(230): n is a, c, g, or t
agcagtaggcgtagctggcacagacatctgcttcgcgaaccctccttgtcactgactcgatcagttatgcactcagaaagcgtctggtcagagtgagggctccatcgtcagtctgcgatgacataccctgcatgcattgctgagcaatcatagtgaggtctggcatcgatctgtctgtcatgccacactgtggctgctcctacgctcagtggaccgcagtatatcatgtnccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtgg

SEQ ID NO: 444861 - DNA, 746 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagagagcagccagcgggtacagaatggattttggaagagggagtcaccactggacctccaaggaagccacgtgcagacatctacaaccttcgatctcctgacgagtttattgttggccaaaaccaggctatgattgaaccaggatgaatgcgggtgttggaagtagaatatatatatacatataaaattgaaactggcgatggaatatgagaggagccctctg

SEQ ID NO: 444862 - DNA, 633 bp, Homo sapiens
gtgttgcataaggtgatctagaggatcccgcaaggtctgtcggtacctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444863 - DNA, 3066 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctgagtcttgctctgtcgccaggctggagtgcagtggtacaatctcggctcactgcagcctctgactcctgggttcaagtgattctcctgcctcagcctcctgagtagctgggactacaggtgcctgccaccatacccaggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444864 - DNA, 2658 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444865 - DNA, 2870 bp, Homo sapiens
gggaagggccttggtctctgaagccagcacagagggaatcagcatggccaccctctgaggactgcatcctggctccctgtcctcccaggagaacgtctgtggctttttcctggttgctgtgggagcctcacctgccaaactgcaggctgattgagattcccgcgctggaacagtcaggggttggggctttctatgagtgcgtgccacacacagcccagccttggaggtggtggctctgcaggttcgggattgggagaggcggcatgggcgggcctccctcccgacacaggatctttcctgctgcaagttcgggaccaggagaggcggcatgggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444866 - DNA, 2712 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444867 - DNA, 2690 bp, Homo sapiens
  misc_feature (95)..(95): n is a, c, g, or t
accgtcgtcagagccaccgcgagtgctgctcctggtccccgttcctgacgaggatgcacaggtctcagcggtcccgcacttgaagctggctgacntcgctgcatacttctccttggctgcggaacttggaacgtgtctcagggatcccaggaggtgcaggtgttctacctctgagtttgccctgctccctgggtgagtgccaagcccctgtgagatcacctgggctaacttctgcttttataaaccgcagtgtggctggggacgggatgtcacaggcaccccatctccccatcgggccacaggaggcttggcctctgtccctgccgggagggccgggcagaagacgggcgacccacacagctggcacgttgtgagggcttggatggagtcctgaggctgagggagatggagcagtctctgcggaggaagtaggcagcgaggtcagccagcttcaagtgcgggaccgctgagaccctgtgcatcctcgtcaggaacggggaccaggagcagcagcgtcgggtcggctcggagtgatggagtgtgtggttgtagttacgcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444868 - DNA, 1241 bp, Homo sapiens
tagggaagggcaaccgacttagtctaggtacgaggctgggtgttaatcggccgaggcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgagttggccttgggcagagggaaggatctggctgtggtcctggcctctgcccagacacacccttgtagcctgggccaccttagaaggcccctgtgtgacctgggttcctccagggccccaaacaacagcccagccccctcgacctgtcactggcctgtgcctgtgggccggcagcccgggggtccttttggctcctcacagacgggtctggcactgcctctagctgccctggccacatccgcccttctgcctcccaccaccgaaggcttagagcatgggaagggtctcctgtaaaggccaagagaagtgtttccagatttgcgatcttggagcagcacatacagatggagctgtgtgtgcatagcgatt

SEQ ID NO: 444869 - DNA, 2187 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtgg

SEQ ID NO: 444870 - DNA, 1277 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttcccca

SEQ ID NO: 444871 - DNA, 769 bp, Homo sapiens
ttcccggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgagttctccgtgtgcggcctgctgcagggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtgg

SEQ ID NO: 444872 - DNA, 2603 bp, Homo sapiens
gaccgagctacttccgggagagaatgggagggtggaaaattttgtgcgtttggcgggtttcgctctcttcataagtattgatcattccgcagccctgcggggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444873 - DNA, 2708 bp, Homo sapiens
agtgagccagtcagaggttaacggaaaacggaagctggctggctgagaagaagcttccgttagtcctaccttgaagagaaaagagccagataaagagaaagattaaaagtatgagaaaatacagaagccactggtctcagggagacagagaaggataccaaagaagaagtaactattatgaggggccacacaccagccactcaagggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444874 - DNA, 2597 bp, Homo sapiens
gaccgagctacttccgggagagaatgggagggtggaaaattttgtgcgtttggcgggtttcgctctcttcataagtattgatcattccgcagccctgcggcctggttagcagtcgctttctgatcccggaaaggaccctgagctgggaaatagcgagaggcggggatgttggggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444875 - DNA, 2656 bp, Homo sapiens
ccccaggcttgtcgttagaaaagtaggggactttcctgttgagtatcatgtttacaaaagcaaagtggcttttaaattttaaactaagtatcaaacaagtagataaggtggatgggagggatcttcaggaactgaagggaagtggaacttaagggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444876 - DNA, 2549 bp, Homo sapiens
gaccgagctacttccgggagagaatgggagggtggaaaattttgtgcgtttggcgggtttcgctctcttcataagtattgatcattccgcagccctgcggggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggctattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444877 - DNA, 2561 bp, Homo sapiens
gaccgagctacttccgggagagaatgggagggtggaaaattttgtgcgtttggcgggtttcgctctcttcataagtattgatcattccgcagccctgcggggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444878 - DNA, 821 bp, Homo sapiens
agtgagccagtcagaggttaacggaaaacggaagctggctggctgagaagaagcttccgttagtcctaccttgaagagaaaagagcagcccagcatcaacagcagcaaagcattcaccacagtcatgcagcaacacatcaccagcaagcccactggtcatccagggcagcaccagcagcaaggcatcaccaaaagcaagcacagtaactcattcatgcagagggccaaaacaccagcccactccaagcccctgcgagaccggacacaccgtgacggacggtacgtgaccgccgaccacgtgccagacacaacaactgcatacacaggtcccaagatggcacacgtcatctgagcttttaaaaacttactgtcagatcacggcatgatagacgctgactgacggacgtaagtacaaatattatcactcatgacgacaacgtggcatacacacgacagcaccgggcgactaaaaccatggcatgctatctaggcacacaggcacacacattaactactaggacatgagcaaacatgctggctatcacggggcatggactgccccctacactcacgttatagtatgagaacgacaattggcactatcatagatgaagataccaacggatacaaaatacatgtccacgactcggcaccaaacacaagtaaccaatcggctgacaacacgccaacaatccaggtcacccaaaaactaaaccacgaataccaaggataagctgaccccagacgagacgacataggtgacacgacacagacaagcagcacacaaacaaaaaacaactcacatgcaaaacacaagcaac

SEQ ID NO: 444879 - DNA, 2523 bp, Homo sapiens
cgacgctatatgagtggcatggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444880 - DNA, 2577 bp, Homo sapiens
gtgacgaatcacgtcccggctctctgcactgcggggcggggcccacgctttgctgcccgccctgccggccccacccccagcctggttagcagtcgctttctgatcccggaaaggaccctgagctgggaaatagcgagaggcggggatgttggggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444881 - DNA, 2523 bp, Homo sapiens
gtgacgaatcacgtcccggctctctgcactgcggggcggggcccacgctttgctgcccgccctgccggccccacccccagcctggttagcagtcgctttctgatcccggaaaggaccctgagctgggaaatagcgagaggcggggatgttggggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggctattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaa

SEQ ID NO: 444882 - DNA, 8561 bp, Homo sapiens
  misc_feature (330)..(330): n is a, c, g, or t
  misc_feature (421)..(421): n is a, c, g, or t
  misc_feature (1269)..(1269): n is a, c, g, or t
  misc_feature (3636)..(3636): n is a, c, g, or t
  misc_feature (4437)..(4437): n is a, c, g, or t
gggcgagcgcctccgtccccggatgtgagctccggctgcccgcggtcccgagccagcggcgcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggtttttttttnaaatcaattatccttattttctgttatttgtccccgtccctccccacccccctgctgaagcgagaataagggcagggaccgcggctcctanctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggngtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcacnaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcngacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctcgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtgaattacagagcaggtccagctggctgctctgccccttgggtatccatagttacggttttctctgtggcccacccagggtgttttttgcatcgctggtgcagaaatgcacaggtggatgagatatagctgctcttgtcctctggggactggtggtgctgcttaagaaataaggggtgctggggacagaggagcaacgtggtgatctataggattggagtgtcggggtctgtacaaatcgtattgttgccttttacaaaactgctgtactgtatgttctctttgagggcttttatatgcaattgaatgagg

SEQ ID NO: 444883 - DNA, 8501 bp, Homo sapiens
  misc_feature (330)..(330): n is a, c, g, or t
  misc_feature (421)..(421): n is a, c, g, or t
  misc_feature (1269)..(1269): n is a, c, g, or t
  misc_feature (3576)..(3576): n is a, c, g, or t
  misc_feature (4377)..(4377): n is a, c, g, or t
gggcgagcgcctccgtccccggatgtgagctccggctgcccgcggtcccgagccagcggcgcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggtttttttttnaaatcaattatccttattttctgttatttgtccccgtccctccccacccccctgctgaagcgagaataagggcagggaccgcggctcctanctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggngtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcacnaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcngacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctcgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtgaattacagagcaggtccagctggctgctctgccccttgggtatccatagttacggttttctctgtggcccacccagggtgttttttgcatcgctggtgcagaaatgcacaggtggatgagatatagctgctcttgtcctctggggactggtggtgctgcttaagaaataaggggtgctggggacagaggagcaacgtggtgatctataggattggagtgtcggggtctgtacaaatcgtattgttgccttttacaaaactgctgtactgtatgttctctttgagggcttttatatgcaattgaatgagg

SEQ ID NO: 444884 - DNA, 8435 bp, Homo sapiens
  misc_feature (330)..(330): n is a, c, g, or t
  misc_feature (421)..(421): n is a, c, g, or t
  misc_feature (1269)..(1269): n is a, c, g, or t
  misc_feature (3636)..(3636): n is a, c, g, or t
  misc_feature (4437)..(4437): n is a, c, g, or t
gggcgagcgcctccgtccccggatgtgagctccggctgcccgcggtcccgagccagcggcgcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggtttttttttnaaatcaattatccttattttctgttatttgtccccgtccctccccacccccctgctgaagcgagaataagggcagggaccgcggctcctanctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggngtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcacnaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcngacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctcgtgtcgttacctcagccatcggtctagcatatcagtcactgggcccaacatatccatttttaaaccctttcccccaaatacaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtgaattacagagcaggtccagctggctgctctgccccttgggtatccatagttacggttttctctgtggcccacccagggtgttttttgcatcgctggtgcagaaatgcacaggtggatgagatatagctgctcttgtcctctggggactggtggtgctgcttaagaaataaggggtgctggggacagaggagcaacgtggtgatctataggattggagtgtcggggtctgtacaaatcgtattgttgccttttacaaaactgctgtactgtatgttctctttgagggcttttatatgcaattgaatgagg

SEQ ID NO: 444885 - DNA, 1972 bp, Homo sapiens
  misc_feature (330)..(330): n is a, c, g, or t
  misc_feature (421)..(421): n is a, c, g, or t
  misc_feature (1269)..(1269): n is a, c, g, or t
gggcgagcgcctccgtccccggatgtgagctccggctgcccgcggtcccgagccagcggcgcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggtttttttttnaaatcaattatccttattttctgttatttgtccccgtccctccccacccccctgctgaagcgagaataagggcagggaccgcggctcctanctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggngtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactgggtaaatgatgcgataggatgggaatggccatgggtgtattttgttagtctgatcatccttggctcatttttcgtccttaacctggttcttggtgtccttagtgggtaagcagtcggatccgtgttgcaccttctcctgctgccacgtgtgaggcaactctgcgtgtctcctagctgctccctgacagcttctctgcatgtgtttggactctgatgtcctctcagtgtgttgcttttggattgaactgtgattctttctgcctgtatctgtctgtgagattccgtgtttccaatgcttgccaaacactgttaatttaatgaaaacgttcccccaaagccagttgtgt

SEQ ID NO: 444886 - DNA, 887 bp, Homo sapiens
tttacttctgtagactgtccttttacaggtttttacttttgttttgttttgttttgttttgttttgtttgaaaagcagggctctggtactctagttttgctgtgtgagtataacacttgggacggtcacttactaccagcttcccgggatgcagaggtgtgtggcgttgccattgttggccgcacgtagttgcatttagtagtgtgttgtgcccttaaaaagttgaaattagatattctactgaatgtcttcttggccatcgctgtagacaatttggctgatgctgaaagtctgaacactgctcagaaagaagaagcggaagaaaaggagaggaaaaagattgccaggtaaccctattttcccctgacgtgtttgtccaggggctgtgttgggagccctgcaacagttgcagcctgccaggcttacccccgcatcacggcagctgcagcccccgggttgctgctttgtggatcatggttgaccatgcactgcagaccaaaacggatggaatcttgggcagaagccaggctcttggctgtcatccctcggggctgagagtgggagtcacgtgtccccatgcttaaagaatcactgcagttaattttggtgtcataaaataaatgatgcattcaatgctgattagctctcagatgagaattttaataagatggtctgtgtaatgaatccatcgcattgagattaccaggaagctctgagtttgggttgtgctaggctcttgtggttagtgttgtttctaattaaattctgtccttcattggagcattattgattcagaatcctgattagcatttttatacagagtaacatggttatttggtttcttgtgctcttttctcttctctttagaaaagagagcctagaaaata

SEQ ID NO: 444887 - DNA, 208 bp, Homo sapiens
atgatatctcagctgaaatgatggggagtgtgtgctcaagccctcggaaccagaatcttaacactttttgtctttctttcagtcaagccatctcaaaatccaaactcaggtcagtatcttctttctgtttcttcgtcagcctgtgtgttgcctttgtatgttctcacttctgaattttacgtagtattgctctggacttgagttttcc

SEQ ID NO: 444888 - DNA, 352 bp, Homo sapiens
ctggcagatcttttttgaatgagtgaagtgccaggtaccatgagaaaaccctagctggtaaagatcaaacctgagttagttctaaattcacatacggattttttttgcatgacgaaatctattctctttttcctgacaacttctccacctagatgtttgggaaagttgccatgagagataacaaccagatcaataggaacaataacttccagacgtttccccaggcggtgctgctgctcttcaggtgactgcaactggcttgggcggtgctcctgggcaggggggtccgctaggcgtgggtccagagggacggaggacacaggttattaaagcagtgtgcctttctcagttg

SEQ ID NO: 444889 - DNA, 8111 bp, Homo sapiens
  misc_feature (330)..(330): n is a, c, g, or t
  misc_feature (421)..(421): n is a, c, g, or t
  misc_feature (1269)..(1269): n is a, c, g, or t
  misc_feature (3636)..(3636): n is a, c, g, or t
  misc_feature (4437)..(4437): n is a, c, g, or t
gggcgagcgcctccgtccccggatgtgagctccggctgcccgcggtcccgagccagcggcgcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggtttttttttnaaatcaattatccttattttctgttatttgtccccgtccctccccacccccctgctgaagcgagaataagggcagggaccgcggctcctanctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggngtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcacnaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcngacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctcgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccaca

SEQ ID NO: 444890 - DNA, 8534 bp, Homo sapiens
  misc_feature (330)..(330): n is a, c, g, or t
  misc_feature (421)..(421): n is a, c, g, or t
  misc_feature (1269)..(1269): n is a, c, g, or t
  misc_feature (3636)..(3636): n is a, c, g, or t
  misc_feature (4437)..(4437): n is a, c, g, or t
gggcgagcgcctccgtccccggatgtgagctccggctgcccgcggtcccgagccagcggcgcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggtttttttttnaaatcaattatccttattttctgttatttgtccccgtccctccccacccccctgctgaagcgagaataagggcagggaccgcggctcctanctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggngtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcacnaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcngacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctcgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtgaattacagagcaggtccagctggctgctctgccccttgggtatccatagttacggttttctctgtggcccacccagggtgttttttgcatcgctggtgcagaaatgcacaggtggatgagatatagctgctcttgtcctctggggactggtggtgctgcttaagaaataaggggtgctggggacagaggagcaacgtggtgatctataggattggagtgtcggggtctgtacaaatcgtattgttgccttttacaaaactgctgtactgtatgttctctttgagggcttttatatgcaattgaatgagg

SEQ ID NO: 444891 - DNA, 2170 bp, Homo sapiens
  misc_feature (330)..(330): n is a, c, g, or t
  misc_feature (421)..(421): n is a, c, g, or t
  misc_feature (1269)..(1269): n is a, c, g, or t
gggcgagcgcctccgtccccggatgtgagctccggctgcccgcggtcccgagccagcggcgcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggtttttttttnaaatcaattatccttattttctgttatttgtccccgtccctccccacccccctgctgaagcgagaataagggcagggaccgcggctcctanctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggngtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactggatgaatgatgctatgggatttgaattgccctgggtgtattttgtcagtctcgtcatctttgggtcatttttcgtactaaatcttgtacttggtgtattgagcgggtaagctacacctctttcatcttgaaagcagagtcctgaggacagttgccaagaccacacaagctttgctggatgagggccgccaagaggggttgccagacattttatgtgtcctctgagatgctttcttttctgctgaggcttcccaaatcaagctgtttcctggaacctcaccaggcttcatgaaggagaactatagaacgattattgaccagaaattaatcagcattgttgcttgagatttaaacaatttccatagcatgccctttttttgtctgttctaaagtgagatacatttataattgctttatttgtctggatccaaatataatgcagattaattgttataaaacgatagcaaaatgagctggattgggtgggcttttggtagtccccatttgtagatttcagccgctgagcttgtccttatttgcagaaaa

SEQ ID NO: 444892 - DNA, 2186 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444893 - DNA, 476 bp, Homo sapiens
tccccctccctccctgcctcctccccaccgcactctccgccccccccacctccccactcactgagttccagagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444894 - DNA, 2547 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacaaacaccaacaaacaaaaaaaaaacccgcgggggccttctatgcgccggggcggccgggaaacaagcgggtaattgaaatgggcccatgggtccttcagcggtttccgggaccccaggtttcttggtccacaggtggtacgaaccgggccggggccccctaataggggcgtcgattaaattcgaataagcccgggtaacctggtagatactcgcgagaacaccacggaaacaaaaacgagcgagcaagaacgacaacattcgtcaacaaacggtcgacaccagaacacagagtaaagtactcaacaacatgagataagagagaaagaatgacaaaccagaaaggcagcagactacaaacata

SEQ ID NO: 444895 - DNA, 2208 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaaaaaa

SEQ ID NO: 444896 - DNA, 2058 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444897 - DNA, 2121 bp, Homo sapiens
cgggactcccagcagagattttttttttgtactggctgtgtaacaggacaccgcatgcagccctcaggaggggctctgtgcttctaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444898 - DNA, 2164 bp, Homo sapiens
gcacgagcgggacgtgactctcgctctcgagccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccgcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444899 - DNA, 1890 bp, Homo sapiens
  misc_feature (1785)..(1785): n is a, c, g, or t
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcaagntcaatttaagcagcccttccccttagaccatgagcggggtcccctttgaaaaactagggcccgtttccctccaaaaatagggcggaagcccaagtgctggtagac

SEQ ID NO: 444900 - DNA, 1946 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444901 - DNA, 1609 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444902 - DNA, 1127 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcaccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444903 - DNA, 162 bp, Homo sapiens
actgtgggctctcttgcccccatctccaggggacttgtggcagccagagagctgagggtggttgttggggaggaaggccttgggcttcaagaccaccctgtctgtgcaatcctcacagcccaccgtggtgcacgcaaaccacttcctggccatgcgctccct

SEQ ID NO: 444904 - DNA, 882 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccccttgttaagtcaaacggccattggttcttttaaaagcccccaacttggggaattgaaga

SEQ ID NO: 444905 - DNA, 2335 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacaaaaaaaaaaaaaaaaaactcgggggccatcatatgcggggccggggaacaacgggggtcggactgggcctggccatacctgtccctgccccatttctggccccgtggaaaccgcggccctagggggcgatatccgatagcaggtccgtg

SEQ ID NO: 444906 - DNA, 2230 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444907 - DNA, 2245 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggtgaggggcgggagacgcctgcgtgcgtgcggcccgggggagcgccgagcaatctgggggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444908 - DNA, 2100 bp, Homo sapiens
tctttggcttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444909 - DNA, 1364 bp, Homo sapiens
ctgaccctgtgttttgccccaactacagcacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggcccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444910 - DNA, 966 bp, Homo sapiens
gatgtcagaagacgacagaaggggggtgagggtgttggaggtggggcaggacatggtccttggatcaacagcccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 444911 - DNA, 2377 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444912 - DNA, 918 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctattgaagggcaaacagcaaaagaattatgattgtgaagctgcagtggataccagactggcctcagtgagaatattagaccatggcgggcactacttttggcttcttcgaccattgccggttccccccctagattggt

SEQ ID NO: 444913 - DNA, 1115 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcacttgtaagtcatcagtagcagctttgtgtgtgtgttttgtgtaaatgtgagtctttagcgtctcttaaaatttacagtaacttacagaattgacattgtataatttgtcatttttttccttaaatatttctaagaatgtttactattttttcaagaaattctggataataaatagatatactaggatggcttaaaatagagaaatggttgtaccttgatttaaatccatgtagaaattctaatacattgattaaaggagcaggatatggtgagattctgtaatcttatgttcatgactcgtctcagtttagatcaaagttatttttattaagtcacagaaatcttagaacaaataaaattacttggaagtaaaattatgtgtttctgtattttacagttacatttcttgtgttttttgtgtggttctttcgtaggttcaacctatttttatattttcaagaaatatatggctgggcacagtggctcacgcctgtaatcccagcactttgggaggccgaggcaggtggatcacctgagatcaggagttcgagacctgcctggccagca

SEQ ID NO: 444914 - DNA, 715 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatggtgagtgtttgatttataacactaggcttgatatatcaagccctctttttaaaagaaaaccaaaataatcaaaataagctaaggacagtatgcagaaaaatctgtgttttctgaattacaatgacaatatgttagtctggattttgtaatggctagaatataatgtatttatttatatatgatgattctgttagcaaattaacccttttaaagcctgaaataaattttattcatatcactgactagaatatatcctcattctgggaaaggagagtctttttggtaaatggttttatttaagtaaaactataaacgcatatagtagatatttcttcaatagaactcttaaatagtttaaaaagacaacaggccaggtgcagtggctcactcctgtaataccagcactttgggaagatgaggcaggcaggtcacttgagaccaggagttcgagaccagcctgggcagtatggtgaaaccttgtctctacc

SEQ ID NO: 444915 - DNA, 595 bp, Homo sapiens
  misc_feature (239)..(240): n is a, c, g, or t
  misc_feature (257)..(258): n is a, c, g, or t
  misc_feature (330)..(330): n is a, c, g, or t
  misc_feature (334)..(334): n is a, c, g, or t
  misc_feature (485)..(485): n is a, c, g, or t
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgactgttcgggtnntactgcttaataatganncaatcttctcagggacaggggagcagccccatggcatttgcaacagctattaaccttgggggaacccaaggntttntaaaccgttccccaaggctaacaaacacaacttcgacacgggttactgaacgcatcagcgctacttggattaagccagaaccatggcgacttgggaaatggcaaagttttcggatccaaagaacagaatctgttttaaatttggtccactnaacggacacggagggcccaaaaaaccttttggggaaattttccccaaaaagggaaacgccccccttttggggttttggggcaaaaaggggttaaagggaacagggaagaa

SEQ ID NO: 444916 - DNA, 2401 bp, Homo sapiens
  misc_feature (2396)..(2396): n is a, c, g, or t
  misc_feature (2401)..(2401): n is a, c, g, or t
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgacggggggggggggggggggngaaan

SEQ ID NO: 444917 - DNA, 1848 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttccta

SEQ ID NO: 444918 - DNA, 2359 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444919 - DNA, 1719 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaactaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactca

SEQ ID NO: 444920 - DNA, 2385 bp, Homo sapiens
  misc_feature (1179)..(1179): n is a, c, g, or t
  misc_feature (1181)..(1181): n is a, c, g, or t
  misc_feature (1200)..(1200): n is a, c, g, or t
  misc_feature (1212)..(1213): n is a, c, g, or t
  misc_feature (1241)..(1241): n is a, c, g, or t
  misc_feature (1248)..(1248): n is a, c, g, or t
  misc_feature (1259)..(1261): n is a, c, g, or t
  misc_feature (1269)..(1269): n is a, c, g, or t
  misc_feature (1274)..(1274): n is a, c, g, or t
  misc_feature (1306)..(1307): n is a, c, g, or t
  misc_feature (1311)..(1311): n is a, c, g, or t
  misc_feature (1321)..(1322): n is a, c, g, or t
  misc_feature (1328)..(1330): n is a, c, g, or t
  misc_feature (1335)..(1335): n is a, c, g, or t
  misc_feature (1338)..(1338): n is a, c, g, or t
  misc_feature (1344)..(1344): n is a, c, g, or t
  misc_feature (1356)..(1356): n is a, c, g, or t
  misc_feature (1365)..(1366): n is a, c, g, or t
  misc_feature (1368)..(1368): n is a, c, g, or t
  misc_feature (1370)..(1370): n is a, c, g, or t
  misc_feature (1380)..(1381): n is a, c, g, or t
  misc_feature (1396)..(1396): n is a, c, g, or t
  misc_feature (1399)..(1399): n is a, c, g, or t
  misc_feature (1412)..(1412): n is a, c, g, or t
  misc_feature (1425)..(1425): n is a, c, g, or t
  misc_feature (1430)..(1430): n is a, c, g, or t
  misc_feature (1432)..(1433): n is a, c, g, or t
  misc_feature (1446)..(1446): n is a, c, g, or t
  misc_feature (1459)..(1459): n is a, c, g, or t
  misc_feature (1464)..(1464): n is a, c, g, or t
  misc_feature (1470)..(1470): n is a, c, g, or t
  misc_feature (1474)..(1474): n is a, c, g, or t
  misc_feature (1478)..(1479): n is a, c, g, or t
  misc_feature (1481)..(1481): n is a, c, g, or t
  misc_feature (1488)..(1488): n is a, c, g, or t
  misc_feature (1492)..(1493): n is a, c, g, or t
  misc_feature (1495)..(1496): n is a, c, g, or t
  misc_feature (1504)..(1504): n is a, c, g, or t
  misc_feature (1519)..(1519): n is a, c, g, or t
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagcggcctncncccccgccccgcccccacncccccccgcccnncccccccccccccccccgccgcgacganccccccnggcgatggccnnncgcccccnccccncccccccccccccccccccccccccccccccnncccncccccccccnncccccnnnccccnccncccccncccccccccccnccccccccnncngncccccccatnnccccccccccccacnccnccccccccccccncccccccacgccnccaangnnatcgccccccctnccccccccccccnccccnctcatncaangccnngnccagagngaanncnncccccatnccaatcgcgcccaanccccccaagctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444921 - DNA, 2064 bp, Homo sapiens
tttttttctaaattcattccatcatcaaaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444922 - DNA, 1879 bp, Homo sapiens
catgcccttcccacaaagttacgatccactatctatacacacaaccctcttagtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444923 - DNA, 2322 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444924 - DNA, 571 bp, Homo sapiens
cagctacttgggaggccaaggcaggagaatcacgtaaacccaggtggcagaagttgcagtgagctgagattgtgccactgcactctagcctgcgtaacagagtgagactccatctcaaaaaataaaaaattaaagttaaataaaataagaaattgtttatctgtaagcagctttgaatctttattcattcagtattgtatattttatctacattcagtctgtatgttgtgattatattaaattattgaaacagtagtgatcttaaggtgattgagtgaaaaagtatcactgtatttaaaatcttaagccattttcagtagagctttgaaataatataattttgcatgttttgtgcttattttagcagaagcctgtgatatggaacatttatatctttctttctgtttcaggtgcgtatagcagcaaaattcatcattcatgcccctcctggagaatttaatgaggttttcaatggtgagtgtttgatttataacactaggcttgatatatcaagccctctttttaaaagaaaaccaaaataatcaaaataagctaaggacagtatgcagaa

SEQ ID NO: 444925 - DNA, 416 bp, Homo sapiens
caggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgacattttgtctaaatcatcttttctttagttttaaaatacaagttttggcacattgggattcctaaagaaaatgaattggtaacatt

SEQ ID NO: 444926 - DNA, 1767 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactca

SEQ ID NO: 444927 - DNA, 825 bp, Homo sapiens
  misc_feature (743)..(743): n is a, c, g, or t
  misc_feature (825)..(825): n is a, c, g, or t
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcagattccctaacagtgtctattgaaagtgcaacagncaaagaatttattaagattgtagaagctgcagaaatgaataccagactgccatcagtgagaattattagacccatgtcgacn

SEQ ID NO: 444928 - DNA, 613 bp, Homo sapiens
  misc_feature (609)..(609): n is a, c, g, or t
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactcgcagctatgcaaatgctgctagtgcgccaaaaaaactagcagtgcgcacagccaaacncagt

SEQ ID NO: 444929 - DNA, 2323 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcattaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444930 - DNA, 1888 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctaaaaaaaaaaagtcgacgcggccgcgaatttagtagtagta

SEQ ID NO: 444931 - DNA, 2038 bp, Homo sapiens
  misc_feature (1797)..(1797): n is a, c, g, or t
  misc_feature (1803)..(1803): n is a, c, g, or t
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcaaaaaaaaaaaaaaaaaaaaaaaaaaaaaanaaaaanaaaaaaaaaaaaaaaaaaacctcccacggggggagaaccgcgcgacaaagggggcgcgaacaccctccgggggggggaccccacggacaacagtttgtgtggcccctaatgagaggaaggggagataatcgagagaggtagggaggaaaaaaagggggcaaaaaagagtgacaccggggtgaaaatatggtaacccgcgccaaaaaattcccaaaaaattgcagaaaaaaggcga

SEQ ID NO: 444932 - DNA, 2454 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaagaaatgtatgagagttcctgttctgcatcctcaccagcactgggtgttatgtcctttttattttagccatactattaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444933 - DNA, 2397 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttgctgctgtttttatttttaaggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444934 - DNA, 2317 bp, Homo sapiens
cgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactctgctgtttttatttttaaggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgac

SEQ ID NO: 444935 - DNA, 292 bp, Homo sapiens
  misc_feature (20)..(21): n is a, c, g, or t
  misc_feature (27)..(27): n is a, c, g, or t
cctggcttgctcaggtctcnnggcttnctcaggtccctggcttctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctggcaagccaggcctggcttgctcaggtctacaattcccatatctctaagttccagcctcttctccttaaactcctgactcatttatccaaccactgcagatgtt

SEQ ID NO: 444936 - DNA, 158 bp, Homo sapiens
atcatctttattcagctcaggagtggggtggctggaagcataagcttcaggtccagagagcaagtggcagaggctggatccaaacccatcttcctggacctgaagcttatgcttccagccaccccactcctgagctgaataaagatgatttaagctta

SEQ ID NO: 444937 - DNA, 2168 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagctta

SEQ ID NO: 444938 - DNA, 2234 bp, Homo sapiens
tctaccttaccctctgactgggaggcagagacccaagcagctggaggctctgtgtgtggcctggagaccccacaacctccagccggaggcctgaagcatgaggccatgccaggtgccaggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444939 - DNA, 2174 bp, Homo sapiens
tctaccttaccctctgactgggaggcagagacccaagcagctggaggctctgtgtgtgggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444940 - DNA, 2041 bp, Homo sapiens
tctaccttaccctctgactgggaggcagagacccaagcagctggaggctctgtgtgtggcctggagaccccacaacctccagccggaggcctgaagcatgaggccatgccaggtgccaggagcagcgactggacccagagccatgtggctgtgccctctggccctcaacctcatcttgatggcagcctctggtgctgtgtgcgaagtgaaggacgtttgtgttggaagccctgactcttccccataatcactgaccagccttgacactccccttgcaaactctcccagcactgcaccccaggcagccactcttagccttccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444941 - DNA, 2026 bp, Homo sapiens
tcgccagcacgggattcctggagcaagagacccaagcagctggaggctctgtgtgtgggagcagcgactggacccagagccatgtggctgtgccctctggccctcaacctcatcttgatggcagcctctggtgctgtgtgcgaagtgaaggacgtttgtgttggaagccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444942 - DNA, 2081 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444943 - DNA, 2135 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444944 - DNA, 1973 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcatcaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444945 - DNA, 1727 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgctaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444946 - DNA, 1623 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctggcaagccaggcctggcttgctcaggtctacaattcccatatctctaagttccagcctcttctccttaaactcctgactcatttatccaaccactgcagatgtt

SEQ ID NO: 444947 - DNA, 1174 bp, Homo sapiens
catactatgctccaattggtcaagaatctccgatgtatccgccggatcgtctcaccagtcgagcctgtctgtatgactagctctgtcgatgtgacatggagccacaccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444948 - DNA, 1325 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444949 - DNA, 873 bp, Homo sapiens
  misc_feature (20)..(21): n is a, c, g, or t
  misc_feature (27)..(27): n is a, c, g, or t
cctggcttgctcaggtctcnnggcttnctcaggtccctggcttctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444950 - DNA, 570 bp, Homo sapiens
  misc_feature (569)..(569): n is a, c, g, or t
tctaccttaccctctgactgggaggcagagacccaagcagctggaggctctgtgtgtggcctggagaccccacaacctccagccggaggcctgaagcatgaggccatgccaggtgccaggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagcaatgtggacgactgggaagaggagaccattgagttcttcgtcactgaagaaatcattcccctcgggaatcaggagtgacctgagcactgtgggtcggactccgcctgctacccgcgcgagctacagaatccgcnt

SEQ ID NO: 444951 - DNA, 2204 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444952 - DNA, 2245 bp, Homo sapiens
tctaccttaccctctgactgggaggcagagacccaagcagctggaggctctgtgtgtgggtcgctgatttcttggagcctgaaaagaaagtaacacagcagggatgaggacagatggtgtgagtcagtgagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444953 - DNA, 2173 bp, Homo sapiens
tcgccagcacgggattcctggagcaagagacccaagcagctggaggctctgtgtgtgggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444954 - DNA, 2062 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacggggagtgatgctttgtcaaagcatcactccccgtattcctcagtatatttcttcagtgccatgggatattga

SEQ ID NO: 444955 - DNA, 2079 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444956 - DNA, 2190 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagaactctaacgcacaaacaaaaccacgaatccccccacaccccaacaaaacaaaaccaccccggaaacacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444957 - DNA, 1937 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcatcaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagctta

SEQ ID NO: 444958 - DNA, 1657 bp, Homo sapiens
tctaccttaccctctgactgggaggcagagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactcatcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcattaatccattcacccagatatttcattaaaattatcacgtgccaggtcttaggatatgtcgtggggtgggcaaggtaatcagtgacagttgcaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444959 - DNA, 1274 bp, Homo sapiens
gaggctatcgaggaccgtacgccacgctgagcgactctcattcctctgatgggcctcggtactcattccgcccatacatacagctgatcatggcttgtaggactcccgttggaatacttaccccagtaatgaacgccaggcggccactgcttagtattggactatcgacagttgtagatgtacgtcggcggccttatatcggcatctgtctaccagggtgtccttcacgttgacagtactggtcatgccaagttgaagtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacatcaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagc

SEQ ID NO: 444960 - DNA, 1259 bp, Homo sapiens
tctaccttaccctctgactgggaggcagagacccaagcagctggaggctctgtgtgtggcctggagaccccacaacctccagccggaggcctgaagcatgaggccatgccaggtgccaggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagctta

SEQ ID NO: 444961 - DNA, 982 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgaatgaagatgaaggatcattgatttccttgtgtatggataatccgggaacaggccaactaaatatttgatgaatgtatgatttcaaatacagtgaattccctgggagtcatcaaagaagaccggcattttatggttgtttttattaagtgtatattctttgctcctgaaaatgttattaaataattgtttaggccgggcatggtggctcatgcctgtaatcccagcactttcaaaggctgaggcaggcagatcacctgaggtcaggagttcaaaaccagcctggccaacatgctgaaacctcgtctctactaaaaatacaaaaattagctgggcgtggtggtggatacctgtaatcccagctacgtgggaggctgaggtgggagaattgcttcaacctgggaggcagaggttgcagtgagccgagatcatgccactgcactccagcctgggcaacagagcaagactgtctcaaaaataaataaataaataaaattgtttaaatgaaaaaaaaaat

SEQ ID NO: 444962 - DNA, 1024 bp, Homo sapiens
aatcacatgaatgcagccatacaattttgaccagtgattatacccatgtaacccaggaatgtcagccccattatgatgtaaaacattcccatttctttagaaagtcccttaggccccttcccagttggaggtttggagggtttagtttgtgttttaatattctcagagggcctaattagtttgtgtgtgtggcgggtcacctagctaatgctgtgagctgaaaaacgtctgagagaagatagtactgttgttcatctcaaaataacccatcacaaacactgagctttcaattcattcagaatatttttttaggaataaatcttgtaaggtgaaagtgctggggaatatgtaacagatcttgtcttcagagttactgaaatgtaagatgtctgctttttctcttttaaagaatcctcgcaaggctcgtgtaactcggcgtttcattgtagtagaaggattgtatatgaatactggaactatttgtcctcttccagaattggtaagcaaccatgttcagctgtaattttaatatttggactatttgacagatgtgccttttgtttatgaccgcttttagtgtataacgtctgcgttgctttgcgcattaggcctcataagcatattttgctcagatcagggaagaagaacaacactgaatgccagtgctggccttcaaagagtaatcaagactgctctgttgcccaggctggagtgcagtggtgtgaacacagctcactgcagccttaccctcctgggctcaagtgatccttccaccttagctttctgagttagctgggactacaggcacatgccaccacacctggctgatttttcccttttttgtggagtaggggtctcactgcgttacccaggctgttctcaaactcttgggctcaagcgatcctcctgcctcagcctgccaaagtgctggtattacaggtatgagccaccacacctggccaaaacttagctttagctttttttttctcccccgcaagacagtcttgccctgtcgtcaggctgg

SEQ ID NO: 444963 - DNA, 714 bp, Homo sapiens
acgcgcttgtgacccgccttccggaaggaagcggctaactatggcgaccgccacggagcagtgggttctggtggagatggtacaggcgctttacgagctccggaaaggaacacgtgtaaggggacgcaggagacaggtctgcaaaaaccagagtttagacggacgataaaacggagtggtgaaaatgagtggaacaccttcgtctgggaaggtcctaaggaagtcagctctttggaactacggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcagggtaaatacaatattacaaatgcatcttaagaaattccttcacatccatcacttactcttgcctctcatacggataactactgtcttgaagttggtgattgtgttttctttgcctatatttataattttaccatatatgcctgttgccataaaaatacttggtttattttaaaatgtgatacaagatattttcctgagtagtattgttctgattctgatctgatcaaacaggagcttctattctttacttctgtagatctcttcagtctt

SEQ ID NO: 444964 - DNA, 2726 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444965 - DNA, 2913 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgaatgaagatgaaggatcattgatttccttgtgtatggataatccgggaacaggccaactaaatatttgatgaatgtatgatttcaaatacagtgaattccctgggagtcatcaaagaagaccggcattttatgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444966 - DNA, 2710 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444967 - DNA, 2418 bp, Homo sapiens
gtcgtcacctcgggctggttcgctcgggttaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444968 - DNA, 2193 bp, Homo sapiens
tctgaatcttcatcactgatactaattcagagaaccagaaaatgtgtgtctctgtgctcattcatatgcttgcttctcagatggcctggcacgcctaccttctgatcagatactttagttttgggattttccttgaataaaaaaaggaaaatatcaagaaaagattgtaaaaattactttactatagttgattttttaccaaattgtttaggataaagaaataagcaataaatttgtaccctttgattcttagccagattaggatcttgatgagaacaagaggcattgattgttcttgaaagcatcattccaggtttgttgaaagtgggatactgaggtgagaaggggccagttagcacgcaccagagacaaagcttgggccttcaggggagtatgggttcttggctctgttagtatgtagaaggatttgtagcattttaaattgatgaacttgatctgggtcttcaaaaatatttttaggttagtactatcataagtttcaaatagactctcaaacgtatttttttcatctaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444969 - DNA, 1992 bp, Homo sapiens
tgtatcgattgcacctcacttctctcatgcatcccaactcaaaacgttcagaacttatcacttttcccccaaaagctgttctctttcctgtacaacttatttggtaagtggctccacctatacttggagctctaagcagccgtgtaagaagtacaaacaccctgctggagaggtcatctggaaagggcctgaaactacatcagagggagaggacccctgagccctaccttccagccctctgcatcaaggcaccaggcatatggatgaagatgtcttggatcctccagatcggactagctgctagctaaacaccgctgagtgatccagtcaacaccatgtggggcagaagaatctcccagctgagcggtgtttatcgatgccaccaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444970 - DNA, 1406 bp, Homo sapiens
tgcccccttttttgtagaccccctctgatacgatcgagctcgtacccgtcgccacatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444971 - DNA, 1345 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggtaagcaaccatgttcagctgtaattttaatatttggactatttgacagatgtgccttttgtttatgaccgcttttagtgtataacgtctgcgttgctttgcgcattaggcctcataagcatattttgctcagatcagggaagaagaacaacactgaatgccagtgctggccttcaaagagtaatcaagactgctctgttgcccaggctggagtgcagtggtgtgaacacagctcactgcagccttaccctcctgggctcaagtgatccttccaccttagctttctgagttagctgggactacaggcacatgccaccacacctggctgatttttcccttttttgtggagtaggggtctcactgcgttacccaggctgttctcaaactcttgggctcaagcgatcctcctgcctcagcctgccaaagtgctggtattacaggtatgagccaccacacctggccaaaacttagctttagctttttttttctcccccgcaagacagtcttgccctgtcgtcaggctgg

SEQ ID NO: 444972 - DNA, 709 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggtgagtagcacatattgctgaagtggacagataacattactgatttaagaaactagacataaaagacaaaggcaggctgggcgtggtggatcacttcaggtcaggagtttaagaccagcctggccaacatggtgaaaccccatctctaccaaaaaatacaaaaattagcagggcatggtggcacatgcctgtagtcccagctacttgggaggctgaggtgggagaatttcttgggcccaggaggtggaggttgcagtgagccaagatggtgccactgcactccagcctgggcaacagggcgagactctatctcca

SEQ ID NO: 444973 - DNA, 630 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttggtaagtttttgttgtgttctctttgagactactgctttcaatagttaagattcaattttaggctgggcatggtggctcacacctgtactcccagcactttggggaggctgaggtgggaggattccttgagcccaggaatttgataccagcatgggcaatatag

SEQ ID NO: 444974 - DNA, 2780 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444975 - DNA, 2727 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttggggga

SEQ ID NO: 444976 - DNA, 2386 bp, Homo sapiens
actccctgccactaggcagggcctccccagcccctactggcctgccccacctccatttggactggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctga

SEQ ID NO: 444977 - DNA, 1614 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaacataactggagtagcttcagaactaaggcggccacattcaccccaccgcttaggagttagcttcattatacacaaccaagcacaggagaaacactcaccaggaaaagatgccggaggcttggaagttctcaagggaactgtttagacagaggtacgaacatctcattcagaacttccaaatacactaacaataataaaaatgtgcctctcaa

SEQ ID NO: 444978 - DNA, 720 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtctatagtacgactagagctgcctcgctatgcaaaatctagaagaggagttacacgcatgaaagaagcgacagggggttaccccaagcaaaacgaaatggctgtcccggagaaacggcgca

SEQ ID NO: 444979 - DNA, 815 bp, Homo sapiens
acgcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcagggtaaattgattttgctacctgaagtacttgtatttggcttcttgtagtaacctgcagtctatagtgctttatatgtagtagtcctttttttatctgaaacaaaacattttgaagttcccaggagtaacagctttagctcctgattttaaaaaatttattctagggatgatacaggcattttttaaaatctccaatttaagcattaatgtttgcccttttttccaagaatgcacacatgttaatatttccaatggtcgaacacttaaaatgaaaagcaacagacttctgctttttacccatctggttattttctgattttaaatttgtcgcacgttaccctcataattctagatactgtatagtatgcttaactaccatttgttgattcatcaactacagacaacacctgttgatccccacaatatgaattatggagcttccgctcacttatgcctctttcctccttgcttccagtgtctcatctattttttacttttcattctcttggctatctt

SEQ ID NO: 444980 - DNA, 499 bp, Homo sapiens
  misc_feature (24)..(24): n is a, c, g, or t
  misc_feature (43)..(43): n is a, c, g, or t
aaattaagggtattattaaaatangtgacaattggtttatttnatgttagattacaggcggcctaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaac

SEQ ID NO: 444981 - DNA, 2072 bp, Homo sapiens
gggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaagtgagcttttgtttttggggggagatgtttactacaaaattaacatgagtacatgagtaagaattacattatttaacttaaaggatgaaaggtatggatgatgtgacactgagacaagatgtataaatgaaattttagggtcttgaataggaagttttaatttcttctaagagtaagtgaaaagtgcagttgtaacaaacaaagctgtaacatctttttctgccaataacagaagtttggcatgccgtgaaggtgtttggaaatattattggataagaatagctcaattatcccaaataaatggatgaagctataatagttttggggaaaagattctcaaatgtataaagtcttagaacaaaagaattctttgaaataaaaatattatatat

SEQ ID NO: 444982 - DNA, 1766 bp, Homo sapiens
gggctgcctcacttctgcctgatttgggaagcgctgcaaggacaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcagaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaac

SEQ ID NO: 444983 - DNA, 1529 bp, Homo sapiens
gggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcacccatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaac

SEQ ID NO: 444984 - DNA, 1678 bp, Homo sapiens
gggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaac

SEQ ID NO: 444985 - DNA, 279 bp, Homo sapiens
ttttatgaacttttcggggcttactttttcacccatcgacaatagagattatctcttcccctccattgcgcgttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaggaagatgcttgggagcaggca

SEQ ID NO: 444986 - DNA, 1500 bp, Homo sapiens
atctaatcactccatttcatccagactgagatagatggctcacatttttgttgttattgttttctgtaatccttgggtaaattttttttcccccactaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaac

SEQ ID NO: 444987 - DNA, 1617 bp, Homo sapiens
gggctgcctcacttctgcctgatttgggaagcgctgcaaggacaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcagaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcacccatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaac

SEQ ID NO: 444988 - DNA, 478 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaa

SEQ ID NO: 444989 - DNA, 1286 bp, Homo sapiens
actgccggctccacctcccacgtacaaacgattctcctgcctcagcctcctgagtaggtgccactacaggtgcctgccaccacgcctggctaattattgtatttttagtagagacagcgttttgccatgttggtcaggttggtctcgaactcctgaccgcgggtgatccacctgcctctgcctcccaaagtgctgggatttcaggcgtgagccactgcgcccagctatgttaccattttcttgagcacgaaacttgataagatgcaatgcgctttaggtgggtcgtggcaaacatgaaaaggcaagcttccgttttagaatccatggctcttcttgaagacttctctaaagtgcatgatccctaacaagcgcggctccgtcctgtgtctgctctccatcctctgtaccgccgccccttgccttatgtgccttacatgacgccttcttgttcttggttcgttgtgcgacaggatctatgtgttttcccccctctccgtctgctctttgatcagtacgccaagtgccggtgcttgccagacttcccagcccttaggaactgcatttcctgatgctgctgctttcactcctcctgctcgaaaatggagacgaataacacaactcgcaggataaaaacagaattgggagttttcagactgcaaacctttctgaagagaaagttctaatatttcacgggtgtgttgtttcttaactatcttctgtgcgcatgcgcagagcccaccttgcagagccgtgtctgtatggggccgcggtctcactaggcagtccgtgccccagtactggccttccaggtagagtggttttagatcagagttttgtaacccacgtcttggtcagttatcaccctccctatagtaactaaaatagtacgttctgctttgaaggtgtccctacaccacaccgaagatactcaccttgtggagattggaaggatgccagctctttaaatgagacatcgtttttgcttaacgtaacttaaaaatgaaaaacagagcttttgatattaattgaaatagtgagaaaataaatgtatttaggttatttttttgtggagcatgaatggaagttaagacagacctaatgacctgatttacagaaattgagtcagtacaaatcttaacccaaatatcagcctgtgttcccgtgctggttttgattttgccattatgttatattgtgtgtcctgctgcaggagaccagtacttcttttgcctcaacccctacttgtagtttcgaattaccaaatgtttaaatgctgtgttgttgtt

SEQ ID NO: 444990 - DNA, 1326 bp, Homo sapiens
actgccggctccacctcccacgtacaaacgattctcctgcctcagcctcctgagtaggtgccactacaggtgcctgccaccacgcctggctaattattgtatttttagtagagacagcgttttgccatgttggtcaggttggtctcgaactcctgaccgcgggtgatccacctgcctctgcctcccaaagtgctgggatttcaggcgtgagccactgcgcccagctatgttaccattttcttgagcacgaaacttgataagatgcaatgcgctttaggtgggtcgtggcaaacatgaaaaggcaagcttccgttttagaatccatggctcttcttgaagacttctctaaagtgcatgatccctaacaagcgcggctccgtcctgtgtctgctctccatcctctgtaccgccgccccttgccttatgtgccttacatgacgccttcttgttcttggttcgttgtgcgacaggatctatgtgttttcccccctctccgtctgctctttgatcagtacgccaagtgccggtgcttgccagacttcccagcccttaggaactgcatttcctgatgctgctgctttcactcctcctgctcgaaaatggagacgaataacacaactcgcaggataaaaacagaattgggagttttcagactgcaaacctttctgaagagaaagttctaatatttcacgggtgtgttgtttcttaactatcttctgtgcgcatgcgcagagcccaccttgcagagccgtgtctgtatggggccgcggtctcactaggcagtccgtgccccagtactggccttccaggtagagtggttttagatcagagttttgtaacccacgtcttggtcagttatcaccctccctatagtaactaaaatagtacgttctgctttgaaggtgtccctacaccacaccgaagatactcaccttgtggagattggaaggatgccagctctttaaatgagacatcgtttttgcttaacgtaacttaaaaatgaaaaacagagcttttgatattaattgaaatagtgagaaaataaatgtatttaggttatttttttgtggagcatgaatggaagttaagacagacctaatgacctgatttacagaaattgagtcagtacaaatcttaacccaaatatcagcctgtgttcccgtgctggttttgattttgccattatgttatattgtgtgtcctgctgcaggagaccagtacttcttttgcgcactacgccttactcgtctattcatatatccaatattaatactatgatgtctattgttacatatacgatgggttactcaaggaacaacaatgacg

SEQ ID NO: 444991 - DNA, 1636 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccagggaacgaccgaggcggcacacagggtgtccctacaccacaccgaagatactcaccttgtggagattggaaggatgccagctctttaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaa

SEQ ID NO: 444992 - DNA, 1414 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaa

SEQ ID NO: 444993 - DNA, 1452 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccagggaacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaa

SEQ ID NO: 444994 - DNA, 641 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagcttgaggccgagggcgaggccatggaagatgcagccgcgccagggaacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaa

SEQ ID NO: 444995 - DNA, 768 bp, Homo sapiens
tccatttcttaaattggaaggctgtatgttttagaataaacttccaagtaatatctttctttttctttactgtggcttttgtaggcttttcttttttaattagacaatttgttcctcacagatagggttgatgaagaacgcttggtaggtaagcacctgtgtgtgagccgagtcattcataaagaactgttcacagataggttgatgaagaatgcttggtaggtaagcgcctgtgtgtgagccgagtcattcataaagagctgttcacagatagggttgatgaagaatgcttggtaggtaagcacctgtgtgtgagccgagtcattcataaagagctgttcacagatagggttgatgaagaatgcttggtaggtaagcgcctgtatgtgagccaagtcattcataaagagctgttcacagatagggatgatgaagaatgcttggtaggtaagcgcctgtgtgtgagccgagtcattcataaagagctgtccttgtgttggtctcatgggcatcgtgtttcctccgcagagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaa

SEQ ID NO: 444996 - DNA, 580 bp, Homo sapiens
gtcagtaataagtaatgtgtcatgaaatgtctgtaattttgactgagttttaagttgttttgttaaataacattcctctttatgccgtttcccagatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacatt

SEQ ID NO: 444997 - DNA, 1573 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccagggaacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaa

SEQ ID NO: 444998 - DNA, 1481 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccagggaacgaccgaggcggcacacaggaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaa

SEQ ID NO: 444999 - DNA, 759 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttcttggaaacggggctcctcacactctgtgttccacccaggcgtggagttgcccgggggcacaattctctcgcgcctcaaagtgcgaaattccggcctccgtgggtttcaaggtgatcctcccgacattaagcctctccccaagttaggcgtgggacatacacagggatacttccaccacacagggtccagcacataacttgcggatatttttcagcacaaaaaacgg

SEQ ID NO: 445000 - DNA, 3652 bp, Homo sapiens
caaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttc

SEQ ID NO: 445001 - DNA, 1632 bp, Homo sapiens
ctatgctacttgctgtctttgtaacttgaaaaagttactcaactccttttagtatcagtctgtcatgggtaaatgatttgctatgaagaatacagtaaaagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttc

SEQ ID NO: 445002 - DNA, 3510 bp, Homo sapiens
tttttgcataccgtatatgtgttgcttttgtgatggaggaaacattttgtttttaaatgtcgtgtggtctatcagtgtacaattcattgtatgcctgtaatgcacctagtacctactacctgagtactccagcccaattaggggaaggcagatcaccaagaaatgtaacacagtctgtataaagaattagaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaatta

SEQ ID NO: 445003 - DNA, 4662 bp, Homo sapiens
caaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaatta

SEQ ID NO: 445004 - DNA, 4001 bp, Homo sapiens
tggggtctttgctcagaataggacacgctcattgcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaatta

SEQ ID NO: 445005 - DNA, 3150 bp, Homo sapiens
acaaggaaggataagggccaaatgatgagcgaggttggtgaggtagacataagggaggaagaggaaacatccaacaacttgtggtgcagagatataagacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaatta

SEQ ID NO: 445006 - DNA, 3197 bp, Homo sapiens
tataaaatggtatgcaaaatatgcatgggctgattttacctgctgacttcctttaattttgaattatccccagatgttttcagaaatttgaaattgttagtgttttaagattaatgaaaccatttccttgagctgattcacagtctatatgatgagcagagtagaattactgctgtttattaaacagaattcagagcgaatctccatctctctcccctgccaagcatctaccagaagccatttagagaaaaagaatatttgcccatttgattttaggctaatgcaaatgagtgggaattctgacacatgcaaacgtgttcagaagaggcaaagaagtactttaaacacacacacacacaaattattattgtctcttaggtttggatattgatgggatatacagagtaagtggcaacctcgcagtgatccagaaactaaggtttgcagtcaatcatggtaagattatatttactgttgttattcagatgcatcactcataactttttgaactggcttaaagtaattttttaaaatgtccaattcctgctgtttttcagatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaatta

SEQ ID NO: 445007 - DNA, 2501 bp, Homo sapiens
ctatgctacttgctgtctttgtaacttgaaaaagttactcaactccttttagtatcagtctgtcatgggtaaatgatttgctatgaagaatacagtaaaagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaatta

SEQ ID NO: 445008 - DNA, 2496 bp, Homo sapiens
caaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagaaggttggtaggagaagtattgttgataataatgaatgttggcctacgtcataaataaaatgtttcaaattaaaaacaaacattttcaaacagtaagaatattattctttattcatgtattcaagtacagtgattaaaagacattaagtaattaaaatagtttttttgaaagtttattttaactaaagtagtggacagacataaataacacactaaacttttagaaagcctgtttcagaggaactacatggatgtgatgggtggcagacttttagaaattgtgacaatgaaaagtttagttttgagatgcaaagatcacaataaataagaaattttgaatatcactaacaatagaaagaaaaatgaacaaataatttttacccttggctgtcatttaaggtaactgaaaaattagcataaggtgtttttttctaactaatttatttgcctgttatttcatttataagcactataatggactaacaatcttttttttataggaaaatattctttaaaaaaatcacattacttgtgtatgtagttcttacgagcgtgtttaattccaaaggtaaaattttctaatacctgacttaaaacaatggcatttatttgtaaataaaaataaaagtaaagataatatagtctataatg

SEQ ID NO: 445009 - DNA, 891 bp, Homo sapiens
  misc_feature (613)..(613): n is a, c, g, or t
  misc_feature (616)..(616): n is a, c, g, or t
  misc_feature (631)..(631): n is a, c, g, or t
caaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggtttaaatgtgatactggtgtagatctccttgtnctnagctatattcatccnacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataacaaggggagaggtacatcttggtgaaaaagacctatgatgactgtgcagtcagccagataaaactccgagcgagttatatgccactcctacgggtcgca

SEQ ID NO: 445010 - DNA, 3462 bp, Homo sapiens
tttttgcataccgtatatgtgttgcttttgtgatggaggaaacattttgtttttaaatgtcgtgtggtctatcagtgtacaattcattgtatgcctgtaatgcacctagtacctactacctgagtactccagcccaattaggggaaggcagatcaccaagaaatgtaacacagtctgtataaagaattagaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgaagtcttaaatgttccaccatcccccccccactagagcgttttgtcacgtgttgcactttaacagtattttatattttttgcaacgccccaagttttagatctttctagagcttggttgttcctcctctcaatctcagatttttttttcccatcctcgcagagacccaattgtcca

SEQ ID NO: 445011 - DNA, 4620 bp, Homo sapiens
caaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaatta

SEQ ID NO: 445012 - DNA, 4641 bp, Homo sapiens
caaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaatta

SEQ ID NO: 445013 - DNA, 2417 bp, Homo sapiens
caaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggcagtccaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagaaggttggtaggagaagtattgttgataataatgaatgttggcctacgtcataaataaaatgtttcaaattaaaaacaaacattttcaaacagtaagaatattattctttattcatgtattcaagtacagtgattaaaagacattaagtaattaaaatagtttttttgaaagtttattttaactaaagtagtggacagacataaataacacactaaacttttagaaagcctgtttcagaggaactacatggatgtgatgggtggcagacttttagaaattgtgacaatgaaaagtttagttttgagatgcaaagatcacaataaataagaaattttgaatatcactaacaatagaaagaaaaatgaacaaataatttttacccttggctgtcatttaaggtaactgaaaaattagcataaggtgtttttttctaactaatttatttgcctgttatttcatttataagcactataatggactaacaatcttttttttataggaaaatattctttaaaaaaatcacattacttgtgtatgtagttcttacgagcgtgtttaattccaaaggtaaaattttctaatacctgacttaaaacaatggcatttatttgtaaataaaaataaaagtaaagataatatagtctataatg

SEQ ID NO: 445014 - DNA, 2328 bp, Homo sapiens
tataaaatggtatgcaaaatatgcatgggctgattttacctgctgacttcctttaattttgaattatccccagatgttttcagaaatttgaaattgttagtgttttaagattaatgaaaccatttccttgagctgattcacagtctatatgatgagcagagtagaattactgctgtttattaaacagaattcagagcgaatctccatctctctcccctgccaagcatctaccagaagccatttagagaaaaagaatatttgcccatttgattttaggctaatgcaaatgagtgggaattctgacacatgcaaacgtgttcagaagaggcaaagaagtactttaaacacacacacacacaaattattattgtctcttaggtttggatattgatgggatatacagagtaagtggcaacctcgcagtgatccagaaactaaggtttgcagtcaatcatggtaagattatatttactgttgttattcagatgcatcactcataactttttgaactggcttaaagtaattttttaaaatgtccaattcctgctgtttttcagatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttc

SEQ ID NO: 445015 - DNA, 846 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgcta

SEQ ID NO: 445016 - DNA, 1115 bp, Homo sapiens
ggtgcgttgaagagagtctgacgcgggagttaggtaagtacccttgggggaacactgttaagcagaggaaaattatcccattatttctatcccccgtgaagttggatggggacccgcagttgggtccctcctatagggagttcaccactgacagtagggccttggcgttggtattcattacacgatggatagtggcttggaaagtgactgagcgttaatcgtaaaggtactcccaatacactacgtcattcacacaacggcactatactttggtggagcctggcacagaggagggaggcttcaagccaaactcacagaaggaaactgacatcctatcatgcaagtgcgacggctacgctagaaagttagatccatccatgacaggaataaataacatgacatgagtttggctccggttaataatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctaaaaaaaaagtt

SEQ ID NO: 445017 - DNA, 879 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagtatgtctcctcccttttggtgcacttcaacaaaaaaagcaataggaggaaaagaagtacgtaataaaagaagcacataaagaagggatgacatccaaaccatcgcagttaaataaggaaccattcagagatttaatcaattgtctcacagatttctggcattgtagaatgtagaatcatagttactcattcaatgaatttttattaacatgccaggtagttttgtaggttcgatagatttttgcactaaatccatcacacaaggctcctgatttcttggggcttacattctagagtccagacagagcacaggcaaatacacaagaaaatatcaatagtgatagagtgaccatataatttgttagtcaaacgatgacacttctgagagtaaaagggg

SEQ ID NO: 445018 - DNA, 804 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagtgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgcta

SEQ ID NO: 445019 - DNA, 1124 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctaaaaaaaaagtt

SEQ ID NO: 445020 - DNA, 1025 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatgaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctaaaaaaaaagtt

SEQ ID NO: 445021 - DNA, 984 bp, Homo sapiens
ctccccctccccgcgctccgcagctgggaatcacgggactagccttcgtttccttggcaacgcagtacacaagtgctagccctagcagctcgcgatgtgcttcagcagagcagggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctaaaaaaaaagtt

SEQ ID NO: 445022 - DNA, 2063 bp, Homo sapiens
gccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccag

SEQ ID NO: 445023 - DNA, 4416 bp, Homo sapiens
gccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacctgaccaatctaggcagcagacagttctttccaaacggccactatttgatttgactgtgattgatcagctgttcaaggaaatgtcctgttgtttgtttgacttgaaagcattgtgtagtattcttaatcagcgtgctcagggcaaggagcctaatctttcattattactgggaataagatcaatgaactgttcagctgaagagactgagaatgaccacagcacagaaacactcactaaaaagctgtcagatgtgtgccagttacgaagagacattgatgaattaaggactacaatatcagaccgctatgctcaggacatgggagacaactgcattactcagtgatcaagtgttagtcccacagcaataatgacctgttgtttaaatgctgctgtgttatggagccataatggaaggttgcaagtgacatgacttgcacttagggattttttttctgtggatttgttttgttgaaggggagaagggaagtgaagagattttgaaggggcttatctaatcaggcaaaaagaaaaaaaatcaaattacctttggaaaatatgataaaatctacaaggaaaaaaatgtctatattctcaaactactgattgtaggaccaagctgtgaagagtacccttcacatgaaggagtaggattccttttaatcctatagctttgtgtgtttgtgtgtgcatgtatgtgtgttgttgtgtgtgtgtgcacgtgctttattcacaaatttataagggtttctagggtcagagcagagcttctgagaaaggcacacgctgtttattcttatatttctttcatatagaagcttgtgttgtactttgggattttcagtggctggctgaacaagagttcaaacagcaggcaagtgttgtcatggtagtacaggaggcaaaaccatttatattttgaacacttactgcactgataggatgttttgtggttgagctgattttagtactgtagataggtcagctgtttttccagagtgattgtggatttcccaagaggtgtgaaattttgacgtgatgctctttttccttagcattgtaatgtatgtgttacaagaaaggttaacataacttgaactaattttaacatgttccttactatttacaattttttatttatatgttttatatatatacatatataaatgtaaacaaagccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatcacagtttaaaatgttggctatacagctctcaatagattattttatagttatagttgaataatcagttataatacac

SEQ ID NO: 445024 - DNA, 4096 bp, Homo sapiens
aaacagctgacccttggctaacattacatgatttggagaaataattggaagtctaccacagggagactaaatgtaaaactccaatcagataaattacaacacggatgtggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacctgaccaatctaggcagcagacagttctttccaaacggccactatttgatttgactgtgattgatcagctgttcaaggaaatgtcctgttgtttgtttgacttgaaagcattgtgtagtattcttaatcagcgtgctcagggcaaggagcctaatctttcattattactgggaataagatcaatgaactgttcagctgaagagactgagaatgaccacagcacagaaacactcactaaaaagctgtcagatgtgtgccagttacgaagagacattgatgaattaaggactacaatatcagaccgctatgctcaggacatgggagacaactgcattactcagtgatcaagtgttagtcccacagcaataatgacctgttgtttaaatgctgctgtgttatggagccataatggaaggttgcaagtgacatgacttgcacttagggattttttttctgtggatttgttttgttgaaggggagaagggaagtgaagagattttgaaggggcttatctaatcaggcaaaaagaaaaaaaatcaaattacctttggaaaatatgataaaatctacaaggaaaaaaatgtctatattctcaaactactgattgtaggaccaagctgtgaagagtacccttcacatgaaggagtaggattccttttaatcctatagctttgtgtgtttgtgtgtgcatgtatgtgtgttgttgtgtgtgtgtgcacgtgctttattcacaaatttataagggtttctagggtcagagcagagcttctgagaaaggcacacgctgtttattcttatatttctttcatatagaagcttgtgttgtactttgggattttcagtggctggctgaacaagagttcaaacagcaggcaagtgttgtcatggtagtacaggaggcaaaaccatttatattttgaacacttactgcactgataggatgttttgtggttgagctgattttagtactgtagataggtcagctgtttttccagagtgattgtggatttcccaagaggtgtgaaattttgacgtgatgctctttttccttagcattgtaatgtatgtgttacaagaaaggttaacataacttgaactaattttaacatgttccttactatttacaattttttatttatatgttttatatatatacatatataaatgtaaacaaagccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatcacagtttaaaatgttggctatacagctctcaatagattattttatagttatagttgaataatcagttataatacac

SEQ ID NO: 445025 - DNA, 3906 bp, Homo sapiens
tgtgtacaaagcaagagaccaagggagctttgaagaagaacttattgtccttaacaccagcttttcatcttgctttatatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacctgaccaatctaggcagcagacagttctttccaaacggccactatttgatttgactgtgattgatcagctgttcaaggaaatgtcctgttgtttgtttgacttgaaagcattgtgtagtattcttaatcagcgtgctcagggcaaggagcctaatctttcattattactgggaataagatcaatgaactgttcagctgaagagactgagaatgaccacagcacagaaacactcactaaaaagctgtcagatgtgtgccagttacgaagagacattgatgaattaaggactacaatatcagaccgctatgctcaggacatgggagacaactgcattactcagtgatcaagtgttagtcccacagcaataatgacctgttgtttaaatgctgctgtgttatggagccataatggaaggttgcaagtgacatgacttgcacttagggattttttttctgtggatttgttttgttgaaggggagaagggaagtgaagagattttgaaggggcttatctaatcaggcaaaaagaaaaaaaatcaaattacctttggaaaatatgataaaatctacaaggaaaaaaatgtctatattctcaaactactgattgtaggaccaagctgtgaagagtacccttcacatgaaggagtaggattccttttaatcctatagctttgtgtgtttgtgtgtgcatgtatgtgtgttgttgtgtgtgtgtgcacgtgctttattcacaaatttataagggtttctagggtcagagcagagcttctgagaaaggcacacgctgtttattcttatatttctttcatatagaagcttgtgttgtactttgggattttcagtggctggctgaacaagagttcaaacagcaggcaagtgttgtcatggtagtacaggaggcaaaaccatttatattttgaacacttactgcactgataggatgttttgtggttgagctgattttagtactgtagataggtcagctgtttttccagagtgattgtggatttcccaagaggtgtgaaattttgacgtgatgctctttttccttagcattgtaatgtatgtgttacaagaaaggttaacataacttgaactaattttaacatgttccttactatttacaattttttatttatatgttttatatatatacatatataaatgtaaacaaagccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatcacagtttaaaatgttggctatacagctctcaatagattattttatagttatagttgaataatcagttataatacac

SEQ ID NO: 445026 - DNA, 2505 bp, Homo sapiens
gccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacatattcacaaggccttcagccaaatattcacaaaaccctcaggagatgtgaaggcaccatctcaaaaggcccttg

SEQ ID NO: 445027 - DNA, 1051 bp, Homo sapiens
  misc_feature (872)..(872): n is a, c, g, or t
  misc_feature (1011)..(1011): n is a, c, g, or t
gccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaaggtgagctaaaattcttattgtttatatatgaatctttgaagagtggttgtggtacaagaattttcaggggatatgttttattgtttcatactgaaaattatagtgtttgaatatttaataatgttcagtgttgctgtatatcaaataaaattgtccctctaatcgaccgggcgcggtggctctcatgatccacctgcctcggcctcccaaagtgctgggattacaggcgtgagcaccgcgcccggcctagatgctcttcttttaaaattcagggcacttcgctnttctgctgaggtttatgaatgtttaaaaactgctttgcggtccccaaagtaatttgacaagtctgacagctattgattaaaaacccgaaattattcaggctgcaggatgacttggggggatttagatggaaagtttttngttttcttcctctcgccctctggcacccctcctcccccgc

SEQ ID NO: 445028 - DNA, 908 bp, Homo sapiens
gccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaaggtgagctaaaattcttattgtttatatatgaatctttgaagagtggttgtggtacaagaattttcaggggatatgttttattgtttcatactgaaaattatagtgtttgaatatttaataatgttcagtgttgctgtatatcaaataaaattgtccctctaatcgaccgggcgcggtggctctcatgatccacctgcctcggcctcccaaagtgctgggattacaggcgtgagcaccgcgcccggcctaggattttttgtttcaagacttagggaaacttctttgctgaggtggggatgataaattattaatactcattg

SEQ ID NO: 445029 - DNA, 691 bp, Homo sapiens
gtgtaaacatgtttctgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaagtaggtttttctaataaagttgaattaggtcaacaacatttcctcagcatataattatttgtctgtcatttaccctgtcaggtgtcatgccaggttatgtatacatttatgtggaggtgattaattttgtagtaacttttgagaagccctctgctgtctgcagaaatccaaggattttctttgaggatagaaatgctcttgtatatctttctaacaaatagtaaaatctttaaaaaattaattgcctacaccaa

SEQ ID NO: 445030 - DNA, 4096 bp, Homo sapiens
gacttctaggaatactgtggtaacaatgaaacataactctggcctaaacccaactgaacatgttctttcataatagctggtaaattaatctgaggccaagcaataaatggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacctgaccaatctaggcagcagacagttctttccaaacggccactatttgatttgactgtgattgatcagctgttcaaggaaatgtcctgttgtttgtttgacttgaaagcattgtgtagtattcttaatcagcgtgctcagggcaaggagcctaatctttcattattactgggaataagatcaatgaactgttcagctgaagagactgagaatgaccacagcacagaaacactcactaaaaagctgtcagatgtgtgccagttacgaagagacattgatgaattaaggactacaatatcagaccgctatgctcaggacatgggagacaactgcattactcagtgatcaagtgttagtcccacagcaataatgacctgttgtttaaatgctgctgtgttatggagccataatggaaggttgcaagtgacatgacttgcacttagggattttttttctgtggatttgttttgttgaaggggagaagggaagtgaagagattttgaaggggcttatctaatcaggcaaaaagaaaaaaaatcaaattacctttggaaaatatgataaaatctacaaggaaaaaaatgtctatattctcaaactactgattgtaggaccaagctgtgaagagtacccttcacatgaaggagtaggattccttttaatcctatagctttgtgtgtttgtgtgtgcatgtatgtgtgttgttgtgtgtgtgtgcacgtgctttattcacaaatttataagggtttctagggtcagagcagagcttctgagaaaggcacacgctgtttattcttatatttctttcatatagaagcttgtgttgtactttgggattttcagtggctggctgaacaagagttcaaacagcaggcaagtgttgtcatggtagtacaggaggcaaaaccatttatattttgaacacttactgcactgataggatgttttgtggttgagctgattttagtactgtagataggtcagctgtttttccagagtgattgtggatttcccaagaggtgtgaaattttgacgtgatgctctttttccttagcattgtaatgtatgtgttacaagaaaggttaacataacttgaactaattttaacatgttccttactatttacaattttttatttatatgttttatatatatacatatataaatgtaaacaaagccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatcacagtttaaaatgttggctatacagctctcaatagattattttatagttatagttgaataatcagttataatacac

SEQ ID NO: 445031 - DNA, 2047 bp, Homo sapiens
gccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaagtaggtttttctaataaagttgaattaggtcaacaacatttcctcagcatataattatttgtctgtcatttaccctgtcaggtgtcatgccaggttatgtatacatttatgtggaggtgattaattttgtagtaacttttgagaagccctctgctgtctgcagaaatccaaggattttctttgaggatagaaatgctcttgtatatctttctaacaaatagtaaaatctttaaaaaattaattgcctacaccaa

SEQ ID NO: 445032 - DNA, 1593 bp, Homo sapiens
gccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggtaaggtgcaaaatctagtgtttgcttccctccagtggatgttatgagtacagtagcacacttacagtaagcatataacaagtgttcacagattgttttgcatttccttttccctgcaagttaataggcagaaatgttacaaaccgaaaagtgttgttgataaacttgcaaagcatttgagactaattaacatgaaaatctgaaaaccttgtaccta

SEQ ID NO: 445033 - DNA, 936 bp, Homo sapiens
agaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacaggtgaccgcacagcggggatagtgggggtcccgtcgggcaggggacggcgagcggggccggcgggctggcaccgaaatcacccggcgccggcagccccctccccgcccgcgcggccgcggcccggaacaaccggccctgcgcgccgcgcaccctgctccgagagcgcct

SEQ ID NO: 445034 - DNA, 472 bp, Homo sapiens
tgaggatacaagagaaatgaatgtttaaacccctaaccgagaaaagtacaatctgtgtatgccacttggaaaaatgaaggctgtggcctaagctgatgtaaagaaaagaacatatgtttcctatgagtaacagaattcacttaaatataagactgtgaatcctaacagaattgcctattcttatataagtgtatataacagtatagtaagttttagaaatttaaggtattactatggtattcttgaaataagattttagataaatgtcatattaatcttgttctttttctgtctcttcatgtagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacaga

SEQ ID NO: 445035 - DNA, 241 bp, Homo sapiens
gactccatctcaaaaaaaaaaaaaaaagtgcatattgtatttttccaaaataacagaccattttaaataatctatttcatcagttaaatatgccaggctggctttttttctgtgtctaatcttcttgctcaattcttcctttcctatagcgacttgaggagattatgaaaagaaccaggagaacagaagctacagataaggtattgacatggccgttttctaactacttttgtatgctttt

SEQ ID NO: 445036 - DNA, 4484 bp, Homo sapiens
agaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaagctgttcaacaaacttgtttaatttgtttaaatcaacatagcatgaaacaccaaataaaatgtttgacatagttttaaaaaaaaaaaaaaaaaaaaaaaaaaaaaaaaaaaaaattttaaggagaaggaaaaaaaaaaaaagaaaaaaaagagagggaaaaaaaaagagagagaagaaaagaaaaaaaaggagagggaggagaaaaaggggaggaggaaaaaaaggg

SEQ ID NO: 445037 - DNA, 3893 bp, Homo sapiens
  misc_feature (30)..(30): n is a, c, g, or t
  misc_feature (50)..(50): n is a, c, g, or t
tcgcttcgcactgcgccgtcgccgcccctntggccgtcgccgccagctcntagctccgccatggtgcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaagctgttcaacaaacttgtttaatttgtttaaatcaacatagcatgaaacaccaaataaaatgtttgacatagttttaaaaaaaaaaaaaaaaaaaaaaaaaaaaaaaaaaaaaattttaaggagaaggaaaaaaaaaaaaagaaaaaaaagagagggaaaaaaaaagagagagaagaaaagaaaaaaaaggagagggaggagaaaaaggggaggaggaaaaaaaggg

SEQ ID NO: 445038 - DNA, 2397 bp, Homo sapiens
gcggccgcaccccaccctggccccggccccagtcccgcagggagacgccccagcccagcagaggagggtgcggactggactgctggtgctcccgctttccacaccttctccatccgccacctcgcccccacctctgggcaccccctgggagacccgggcagcccgcctgtttgtcagaggcagacgccgaccttctgttttcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaagctgttcaacaaacttgtttaatttgtttaaatcaacatagcatgaaacaccaaataaaatgtttgacatagttttaaaaaaaaaaaaaaaaaaaaaaaaaaaaaaaaaaaaaattttaaggagaaggaaaaaaaaaaaaagaaaaaaaagagagggaaaaaaaaagagagagaagaaaagaaaaaaaaggagagggaggagaaaaaggggaggaggaaaaaaaggg

SEQ ID NO: 445039 - DNA, 1959 bp, Homo sapiens
tgaggatacaagagaaatgaatgtttaaacccctaaccgagaaaagtacaatctgtgtatgccacttggaaaaatgaaggctgtggcctaagctgatgtaaagaaaagaacatatgtttcctatgagtaacagaattcacttaaatataagactgtgaatcctaacagaattgcctattcttatataagtgtatataacagtatagtaagttttagaaatttaaggtattactatggtattcttgaaataagattttagataaatgtcatattaatcttgttctttttctgtctcttcatgtagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaagctgttcaacaaacttgtttaatttgtttaaatcaacatagcatgaaacaccaaataaaatgtttgacatagttttaaaaaaaaaaaaaaaaaaaaaaaaaaaaaaaaaaaaaattttaaggagaaggaaaaaaaaaaaaagaaaaaaaagagagggaaaaaaaaagagagagaagaaaagaaaaaaaaggagagggaggagaaaaaggggaggaggaaaaaaaggg

SEQ ID NO: 445040 - DNA, 3250 bp, Homo sapiens
  misc_feature (3206)..(3206): n is a, c, g, or t
agaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatcactttgcccgtcgggggcgggcgtgtaaaattancaaaaaataaataataagttgacgcggccccgaatttattatta

SEQ ID NO: 445041 - DNA, 2720 bp, Homo sapiens
agaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaaggtagctgcgtcttagtagagaggcccgggacgcgaacttgcacctctaagacccagagactagccctggccgtcagaaaacgcgtgttctacccttgccacataaactagtagccccctcagtgataacaatctcctgcaaagaaatctctctcggtgttttagccgtcaccaaaaaacacttacttccacttcatgtagcttaaggcagttccaa

SEQ ID NO: 445042 - DNA, 508 bp, Homo sapiens
gaccattttaaataatctatttcatcagttaaatatgccaggctggctttttttctgtgtctaatcttcttgctcaattcttcctttcctatagcgacttgaggagattatgaaaagaaccaggagaacagaagctacagataaggtattgacatggccgttttctaactacttttgtatgcttttatctttttcattttcacttgtaactctaatttttaaaagtcctctttttttcttcttcgtagaaaaccagtgatcagagaaacggtgatatagccaagggagctctcactggaggaacaggtatttctgtcaatgaactcaaaccaatttatatataaaatgtttaaattgactctccaggggtgaagatattcaggaattgatggagggaaaaaagatccagtgcttacagactcacagaagcttaggggtctgtcatcgagtccttccttcctcttatgtaaaactgtctagtgtttctaccagttacttttcacgtttg

SEQ ID NO: 445043 - DNA, 515 bp, Homo sapiens
agttgtccatgtacacatagtcattatattagaaaagaaagctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaag

SEQ ID NO: 445044 - DNA, 4595 bp, Homo sapiens
agaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaagctgttcaacaaacttgtttaatttgtttaaatcaacatagcatgaaacaccaaataaaatgtttgacatagttttaaaaaaaaaaaaaaaaaaaaaaaaaaaaaaaaaaaaaattttaaggagaaggaaaaaaaaaaaaagaaaaaaaagagagggaaaaaaaaagagagagaagaaaagaaaaaaaaggagagggaggagaaaaaggggaggaggaaaaaaaggg

SEQ ID NO: 445045 - DNA, 4313 bp, Homo sapiens
agaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaagctgttcaacaaacttgtttaatttgtttaaatcaacatagcatgaaacaccaaataaaatgtttgacatagttttaaaaaaaaaaaaaaaaaaaaaaaaaaaaaaaaaaaaaattttaaggagaaggaaaaaaaaaaaaagaaaaaaaagagagggaaaaaaaaagagagagaagaaaagaaaaaaaaggagagggaggagaaaaaggggaggaggaaaaaaaggg

SEQ ID NO: 445046 - DNA, 2997 bp, Homo sapiens
agaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacaga

SEQ ID NO: 445047 - DNA, 3123 bp, Homo sapiens
agaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacaggtatttctgtcaatgaactcaaaccaatttatatataaaatgtttaaattgactctccaggggtgaagatattcaggaattgatggagggaaaaaagatccagtgcttacagactcacagaagcttaggggtctgtcatcgagtccttccttcctcttatgtaaaactgtctagtgtttctaccagttacttttcacgtttgtttatactctaatgggttgcttgatattttaaatcatcttatgtaatatgtatttatgcatatatgtatatatacttatacatatatgtgtatacatatacttttagaagaatttcttttgagtttataaaactaaatttcatttatcacatactgtctgctcaagtagtgtatatttatatttcctcttaagaaaggactttaaatttacacattggacaacttgtattatagaagttctcagaaaaatgatttaaatgttatttatcttagatctgacttcaaaataaagttaaaaatttgttgaa

SEQ ID NO: 445048 - DNA, 358 bp, Homo sapiens
gcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctggtaagagcaaactcacctgtggtctgggtgctctctctttttctcccgcactgttttgatgaagctttttttgt

SEQ ID NO: 445049 - DNA, 1970 bp, Homo sapiens
tagagacggggtttcaccatgttggccaggctggtcttgaactcttgacctcatgtagtccacccgcctctgcctcccaaagtgctgcgattacaggcgtgagccaccgtgcccggcagaggtaaaacgttttcatgttcatgtttttgtaactttgttacatttaatgaacaaattagataaaaagcactatgctcttatgctgcttaatctgtgagaaatgattgtgggggtgggactagttatgaccattcacagttggtgcacttcaatcagtaaatgtcacagaggaaatgtggacggtaaattaactcggcaagtcggtcatgcaaagacgaattagaaatcttaatatttgtaagcagacaaaaaatgtgtctggaaggatcctcacccagttaaatggtatttgctccttgggtgtagagggagggaagggatggggtagaggggaatgtcagagttcactttaacttcatgcacatgtggaaatgtttgaaatgttcacagtaaattttataatttcagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaattaaaaaaaagtcgacgcggccgcgaatttagtagtagta

SEQ ID NO: 445050 - DNA, 1563 bp, Homo sapiens
tagagacggggtttcaccatgttggccaggctggtcttgaactcttgacctcatgtagtccacccgcctctgcctcccaaagtgctgcgattacaggcgtgagccaccgtgcccggcagagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaattaaaaaaaagtcgacgcggccgcgaatttagtagtagta

SEQ ID NO: 445051 - DNA, 1482 bp, Homo sapiens
cagctcctcggagagaatcatttgaacctgggaggtggaggttcccgtgaccccagttcgcacccctgcactccaccctgggcgaccgagtgagactctgtctaaaaaaaaaaaaaaagttaagttggataatgaaaccgaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaattaaaaaaaagtcgacgcggccgcgaatttagtagtagta

SEQ ID NO: 445052 - DNA, 1970 bp, Homo sapiens
tagagacggggtttcaccatgttggccaggctggtcttgaactcttgacctcatgtagtccacccgcctctgcctcccaaagtgctgcgattacaggcgtgagccaccgtgcccggcagaggtaaaacgttttcatgttcatgtttttgtaactttgttacatttaatgaacaaattagataaaaagcactatgctcttatgctgcttaatctgtgagaaatgattgtgggggtgggactagttatgaccattcacagttggtgcacttcaatcagtaaatgtcacagaggaaatgtggacggtaaattaactcggcaagtcggtcatgcaaagacgaattagaaatcttaatatttgtaagcagacaaaaaatgtgtctggaaggatcctcacccagttaaatggtatttgctccttgggtgtagagggagggaagggatggggtagaggggaatgtcagagttcactttaacttcatgcacatgtggaaatgtttgaaatgttcacagtaaattttataatttcagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatggggatcagaactttaaacggcgaaattttttcgagggccgcccctaaaaaggttttaaaaaagggttcaagataaaaattacggactgttcccttgatactattgacactgtatttatcttcagtctcttgttggtatctaactttggttctgaagtttatggaatggaagtatttaattggaaagattaaacatattgattttaattaaaaaaaagtcgacgcggccgcgaatttagtagtagta

SEQ ID NO: 445053 - DNA, 738 bp, Homo sapiens
  misc_feature (443)..(443): n is a, c, g, or t
  misc_feature (445)..(446): n is a, c, g, or t
  misc_feature (453)..(453): n is a, c, g, or t
  misc_feature (464)..(464): n is a, c, g, or t
  misc_feature (495)..(495): n is a, c, g, or t
tagagacggggtttcaccatgttggccaggctggtcttgaactcttgacctcatgtagtccacccgcctctgcctcccaaagtgctgcgattacaggcgtgagccaccgtgcccggcagaggtaaaacgttttcatgttcatgtttttgtaactttgttacatttaatgaacaaattagataaaaagcactatgctcttatgctgcttaatctgtgagaaatgattgtgggggtgggactagttatgaccattcacagttggtgcacttcaatcagtaaatgtcacagaggaaatgtggacggtaaattaactcggcaagtcggtcatgcaaagacgaattagaaatcttaatatttgtaagcagacaaaaaatgtgtctggaaggatcctcacccagttaaatggtatttgctccttgggtgtagagggagggaagggatgntnnaactaanaaaaacagtantgttaaaaatctttgttgtggtttgagcatntttgctgcttttggattgagatggcgaatcaaggcttcacttcctctctcttctgtctttagaaagctgtgatcgtgcgtgcaattatttgaaaggcaacataagccatttaaaaacctgtagttgttaaggaagaaaatggtgggcaagatatcctacctgcccaaatttcgtgggggcaataattaaatggcccaggaaatttctgattggaaccttttttaatttcataaatcctttggg

SEQ ID NO: 445054 - DNA, 1101 bp, Homo sapiens
cctggggatgagctgataacaggaatggatggaaccggtcagctgttttgctattactgcagacccgttgtattaatttttgtgcattaatacatgaacgtagaatattataaatgaaaactgagaagctacaggaagaagaaatcacaatcctatcaacccagaagaaagcattgttaatatttctgtttattttccacttctgtcttccctgttttgtctctttctctcatttaaaaaaaaaaatacatgagttgattgttgatttttgaaaaaatcaggctgggcacagtggctcatgcctgtaatctcaacactttgggaggctgaggcaggcagattgcctgagctcaagagttcaagaccagcctgagcaacatggcaaaaccccatctccactaaaaatataaatagctgggcatgatggtgcccaccggtaatcccagctacttgggaagctgagacatgagaatggcttgaacctgggaggcagaggttgcagtgagccaagatcacaccagttcactccagcctgggtgacaaagtgagactgtcttaaaaaaaaaaaaaaaattgcaacattgcaggtgcgacttaagaccccatcagttaccacccttcctcagtcatcatttgccttatttttatttttccagacccttctctgtgcagttgcatttcatacatgtgccagagctgatgaacagaacagagccaccaccccttctctgcaattctgaaacccaaacagctctgaaaatcaaaatatttttcctaactcgtatgatggcaaaaccaaaacctgccttcaggtatttatgggcgggtttattagagtcattgatgccagtaattgtgagtttatgttttcgtttctgcaaaaattcagtgtttggttttagctgctcacgacccagctgacagtgtaacgtaatacctatgtgtgccctacatggccttttacctcctaaagattctaaattccaagacatatctggccacagaggtttaggataaggagttaagtatggatctgtaattgtgttaaggtttgggcttcccttaaataaaatcataattctgtataccctgctgcacctt

SEQ ID NO: 445055 - DNA, 532 bp, Homo sapiens
ctgagagaggtagaggggccccaacaatttgagctcctactaaaggctaaaggcccctttctggactttggcaaaaaaaggaagtctttttttttttctccttaagttaggggtaggaaaatacatccatcatgaatgtttgaaaccacaccgtagccctcacattcaagttgacctcaataggccatctgtcagagcccagtccaacaagtgactggactggactcttttgtaggcctggtaagtcacttgggttaagacagctaaccttgagcttttcctcccccgcagagaggcactgcccctggtaaagagaccccagaggccccatttttctacaatggaatgtctttgcttgctaatttacagacggttttcaaggatagtgtttaaaatctgagaggatttatccatggataaagagctataggctaaaagactctgcaagttcccagctatttttgtatgttggacatgttatccgttgaaaagcaatcagaaataaaaagtatttaagcgttgtgaggtgcag

SEQ ID NO: 445056 - DNA, 6115 bp, Homo sapiens
tgttttttgcttttccttcaatgacgattcctgtgttccttattccagtgtcatgtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaaaaaaaaata

SEQ ID NO: 445057 - DNA, 5583 bp, Homo sapiens
gaacacgtttcttggtgttgctgtgatgaatggaaagagaggctctggcctctgtcttatttccaccccagtgtgtctctggtgttcaggtcgctgctgtcggacatgtgcttgatgtgtttggagtcatttatgcatatttattctccaacatgagcatgtgtataaatctagggctgaaaagctgtctggactcatcccagtctccattttggcttccagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaaaaaaaaata

SEQ ID NO: 445058 - DNA, 3983 bp, Homo sapiens
gtcaggagtggcaggaaaggacgccgacgagtgttcagcctgtcggaggccgacagtcatggcggccactgggtttagtgctccgaacggcagctgccacggcacctcacgcacagtcaattcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaaaaaaaaata

SEQ ID NO: 445059 - DNA, 6544 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagca

SEQ ID NO: 445060 - DNA, 3436 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcaggtattggccacgtgactcagtgatatggggacatttggagaaccccgtgatccctcaccattaccaaaacccctgacctccaggtcctccttgtcacagcacttgaaggatgctgccgctcaggtgatctgcacatgaagcctctagagattcctctaacttgatgttccctcccaggctgggtcagctcccagatggggaagaattgctcctttttcaggccggtccccaccgaagctgtcactgactgcagagctgatgggcagcaggcgggctgcacctaaacccaccctatcatcacctccacagtcttaggtgtcacaaggaggggtctcccaaggggattgtttgcagtctaggaaaagaatcgcgttcctgctgattttttttttcctctgtaacataccagttttgtccttaaatgtggtgcggtccagttgttcgagtaggcacgcactttgccactctttggtagga

SEQ ID NO: 445061 - DNA, 2954 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggttttcaaggatagtgtttaaaatctgagaggatttatccatggataaagagctataggctaaaagactctgcaagttcccagctatttttgtatgttggacatgttatccgttgaaaagcaatcagaaataaaaagtatttaagcgttgtgaggtgcag

SEQ ID NO: 445062 - DNA, 3744 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccgcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagca

SEQ ID NO: 445063 - DNA, 2131 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataaggtaattggcagagcacagatggacagcagcatggtgtgtattgtagaaacagaagtgtggtgtctggttctatgcagataaacgttatatgtcttcagttattttttatgcctataattactgaataaaaatgctcaatttcatagtccctagagtagcaata

SEQ ID NO: 445064 - DNA, 432 bp, Homo sapiens
gagctgaccccagtcctcatggaaaacaggcaccagccaccaccaccagcatccgctcctttggggtactctgtgcctcctcccacactgtcctctcccactgggcctggtctgccttgtgcccatccatgactctgttggacttgggaggctgtcgatcttagatcaaaagcagagatgaatttggagacctctttctagatgcctcatgatgccacagctcctagccaccctcctcccaaacccaacgaatgccttttcctttgcttctcactgtgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagc

SEQ ID NO: 445065 - DNA, 350 bp, Homo sapiens
aagatgcacgcattcctcatattcacacagcccaaatgcccgcccccccccccacccaccccctgccggtagcaaaaggggcattagacttggcagccctcacaggcagaccttcacccgacagcaaaaacatttctaagggcacaattaggacacagagagaaagcaagatactgaaagaccattttttcttttctgcaggttttcaaggatagtgtttaaaatctgagaggatttatccatggataaagagctataggctaaaagactctgcaagttcccagctatttttgtatgttggacatgttatccgttgaaaagcaatcagaaataaaaagtatttaagcgtt

SEQ ID NO: 445066 - DNA, 6817 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaaaaaaaaata

SEQ ID NO: 445067 - DNA, 5772 bp, Homo sapiens
ctagaggatcctgcaggagagagaatgcgaaaattagctgcggtgctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaaaaaaaaata

SEQ ID NO: 445068 - DNA, 5323 bp, Homo sapiens
tgcattgatgtctgtttgttctgtgtctaccagctgacacgggagctttggtgtggggagtttgtataattgattccctgtgtctggaatacctgacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaaaaaaaaata

SEQ ID NO: 445069 - DNA, 2997 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggtgagccagccccccgccctgcgccacagctcgttcatcatggtgggcgttcaaggtctttctctctgtggagcctgtgtgagctgcccttcctctctcagaagccccgtcggctggcagcaccagcttcttagaatttgtcaaagcacagcgcaagattaaacacagcccccaaaataaattttggctttccctttaaaaaa

SEQ ID NO: 445070 - DNA, 3063 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccagccctgctgactgccgcagtagagaggcagcccagatggccgctcccaagcttgctagtgccttggctgacagactgttgtggaggtctttgcttgctaatttacagacggttttcaaggatagtgtttaaaatctgagaggatttatccatggataaagagctataggctaaaagactctgcaagttcccagctatttttgtatgttggacatgttatccgttgaaaagcaatcagaaataaaaagtatttaagcgttgtgaggtgcag

SEQ ID NO: 445071 - DNA, 3239 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaaggtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccagacccttctctgtgcagttgcatttcatacatgtgccagagctgatgaacagaacagagccaccaccccttctctgcaattctgaaacccaaacagctctgaaaatcaaaatatttttcctaactcgtatgatggcaaaaccaaaacctgccttcaggtatttatgggcgggtttattagagtcattgatgccagtaattgtgagtttatgttttcgtttctgcaaaaattcagtgtttggttttagctgctcacgacccagctgacagtgtaacgtaatacctatgtgtgccctacatggccttttacctcctaaagattctaaattccaagacatatctggccacagaggtttaggataaggagttaagtatggatctgtaattgtgttaaggtttgggcttcccttaaataaaatcataattctgtataccctgctgcacctt

SEQ ID NO: 445072 - DNA, 795 bp, Homo sapiens
tgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtggataacacgtcgcgagggggtcctcatagagtcagcc

SEQ ID NO: 445073 - DNA, 524 bp, Homo sapiens
ctcagtgtgtttccggtttttctcccccaatccagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctg

SEQ ID NO: 445074 - DNA, 2280 bp, Homo sapiens
agaggctgagctctcagccctatctgtctcgtccctgcagcctgtgccaagggcacattcgggcctcactgtgaggggcgctgtgcctgccggtggggaggcccctgccaccttgccaccggggcctgcctctgccctccggggtggcggggggctccaggtgtgagaatggtgagcacagcccccagttcagccagcattgggtgggtcgtacccacagcacctgctcccggcctgtcctggcccacagatccccacgggcccctcctagaagcctccgcagccctcatctttctgcagcctgcctgcggggctggtttggagaggcctgtgcccagcgctgcagctgcccgcctggcgctgcctgccaccacgtcactggggcctgccgctgtccccctggcttcactggctccggctgcgagcagggatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctcctcgtggcctgtgtgtttgctgtgttacgtggactctgtgtgggctcctccctggggcccggccagcataacggtgcacccagggacctcccagtgcacccggggccctttgcaggggtgggggtgccacacaagtgaagaagttgggactcatctcagttcccagtgctattgaggagaacgctggggctgcattcattaccgctgagacccagagactggctgttccc

SEQ ID NO: 445075 - DNA, 1452 bp, Homo sapiens
gacgggcaggagggggcttttctcgggcccctggattggcgggttttactcactctgggcaaactggacatttctgccaccgtgtgcccttgtctcgtggtaaccggcgtccttcagcctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctcctcgtggcctgtgtgtttgctgtgttacgtggactctgtgtgggctcctccctggggcccggccagcataacggtgcacccagggacctcccagtgcacccggggccctttgcaggggtgggggtgccacacaagtgaagaagttgggactcatctcagttcccagtgctattgaggagaacgctggggctgcattcattaccgctgagacccagagactggctgttccc

SEQ ID NO: 445076 - DNA, 692 bp, Homo sapiens
caaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggatt

SEQ ID NO: 445077 - DNA, 771 bp, Homo sapiens
  misc_feature (34)..(34): n is a, c, g, or t
gggactttattacacggcacggcactcgtgacancgaaaggggtggccagaaatgcaggccgggaacattccacagtccagggacggttggtcattcagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctag

SEQ ID NO: 445078 - DNA, 1632 bp, Homo sapiens
caccaagggctggccgcagccactgtagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctgatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445079 - DNA, 911 bp, Homo sapiens
agcggaggtggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagggttagagctaatgcagcaatgatcaagaataaagaatcattaaagaatggggtgttgggggttctcttaattatcagtgacacattaatttttttccttagagcttcatacaataaacacattgcagaaagtttaagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagtt

SEQ ID NO: 445080 - DNA, 1396 bp, Homo sapiens
agcggaggtggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445081 - DNA, 977 bp, Homo sapiens
aatataggctaggtacgaggcatgggtggttgagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtccgttggtttcaacttcccggccctgtttgatggggccgtccggtggggccccgcggtagcgcccaggaagccgtcttggtttcgcgtttggccacgccgaggccccccggggccccgtttcccgtaccgcccggcgggtagccgcc

SEQ ID NO: 445082 - DNA, 701 bp, Homo sapiens
ccacgcgtcgcccacgcgtcgcccacgcgtagagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaacaaagaatgcgaagcacccagagcgtgaaggttgagggccaccccccaagatactgt

SEQ ID NO: 445083 - DNA, 415 bp, Homo sapiens
agcggccgcatactactactactaaattcgcggccgatcgacaccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445084 - DNA, 520 bp, Homo sapiens
caccaagggctggccgcagccactgtagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctgatactttgacgaaggtaattgggactcccatcaagtctccacacagctagcagccacgtggggcacttctccaggttcacagctggagagccattgtctcgggattaattgtaccttgagcatcacctatatctgatttagatgatatttacatgcgactttcgacttacacttgaaagttgatgctggaatgagatgcagcaacaagacatcatcttggaaacagacagcagccccgtttagacctccttctgctgctttgatcttggacctctcatcctccagaaacacgacaaataagtttatgttctttataagttactcatta

SEQ ID NO: 445085 - DNA, 240 bp, Homo sapiens
aattcaagcttctaacgatgtacgggcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445086 - DNA, 5355 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacggtatctcacagtccaggctggagttcagtggcattaacataactcactgcagccttgaacacctgagctcaaacgatcctttcaccttatcctccagagtagctgggactgcagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaggcttggtggtgtgtgtctgtggtcccagctactcaggaggctgaggcaggagaatcacttgaacctgggcggcaaaggttgcagtgagccgagaccatgccactgcactccagcctgggtgacagagtgagactccgtctggaaaaaaaaagaaaaaaatgagatataaagttcaaaggatgtatttattaagccaatataaagtaaagaggtggggaatgttgtagaagtatatgttgataaagggatcaggtggttgtacaataagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctag

SEQ ID NO: 445087 - DNA, 4628 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacaccattatgaatggtttttgattgatctcacaaagagcatgtgctttagacattaatgcagcgactaccatgaaacagagtattggattacctaaggaaagaagcagaggatggaatttgaggcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtgg

SEQ ID NO: 445088 - DNA, 5912 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacaccattatgaatggtttttgattgatctcacaaagagcatgtgctttagacattaatgcagcgactaccatgaaacagagtattggattacctaaggaaagaagcagaggatggaatttgaggcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacaggaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaagttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttt

SEQ ID NO: 445089 - DNA, 5864 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacaccattatgaatggtttttgattgatctcacaaagagcatgtgctttagacattaatgcagcgactaccatgaaacagagtattggattacctaaggaaagaagcagaggatggaatttgaggcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacaggaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaagttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttagtttagcttctggaaaacagcgatgtagcattaatacctctctccctaaagtagttttttcctcaagaatcagctatggcca

SEQ ID NO: 445090 - DNA, 1443 bp, Homo sapiens
  misc_feature (1382)..(1382): n is a, c, g, or t
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaaaaaaaaaaaaaaaaaaaaaaaaaaaaaaaaaaaanaaaaaaaaaaaacaaaaaaaacaaaaaaaaaaaaaacaaaagaaaagaaaaaaaaacaaaa

SEQ ID NO: 445091 - DNA, 1395 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgacaaaaaaaacaaaaaaaaaaaaaacaaaagaaaagaaaaaaaaacaaaa

SEQ ID NO: 445092 - DNA, 1063 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggatccctgagtacg

SEQ ID NO: 445093 - DNA, 1487 bp, Homo sapiens
agccggtacctactttccacagggaggagcggccgccggagatgcctgacgcatctgtctgaggagcggtcagtgacgcgatggagcgggcaagattaaaaataagtagatttaagccaggtgcggtggctcatgtctatagtcccagcacttttggaggccaaggcagaaggatcactggagcctgggagttcaagcttgggtattgagaccccgtctctacatttaaaaaaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445094 - DNA, 1369 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagctttaacatgctttcctctgcaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445095 - DNA, 1299 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445096 - DNA, 2062 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445097 - DNA, 1200 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445098 - DNA, 1194 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatggccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445099 - DNA, 925 bp, Homo sapiens
ccttccaacatctcatttctatagtcaatggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445100 - DNA, 748 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggcgctgttacggaggcgctgttacggaggcgctcgttacggaggcgctcgttacgga

SEQ ID NO: 445101 - DNA, 871 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgc

SEQ ID NO: 445102 - DNA, 4739 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacggtatctcacagtccaggctggagttcagtggcattaacataactcactgcagccttgaacacctgagctcaaacgatcctttcaccttatcctccagagtagctgggactgcagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaggcttggtggtgtgtgtctgtggtcccagctactcaggaggctgaggcaggagaatcacttgaacctgggcggcaaaggttgcagtgagccgagaccatgccactgcactccagcctgggtgacagagtgagactccgtctggaaaaaaaaagaaaaaaatgagatataaagttcaaaggatgtatttattaagccaatataaagtaaagaggtggggaatgttgtagaagtatatgttgataaagggatcaggtggttgtacaataagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctag

SEQ ID NO: 445103 - DNA, 2550 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtgg

SEQ ID NO: 445104 - DNA, 4308 bp, Homo sapiens
ccaccctaggcgcacttctgcacccaggcgcacttctccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacggtatctcacagtccaggctggagttcagtggcattaacataactcactgcagccttgaacacctgagctcaaacgatcctttcaccttatcctccagagtagctgggactgcagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaggcttggtggtgtgtgtctgtggtcccagctactcaggaggctgaggcaggagaatcacttgaacctgggcggcaaaggttgcagtgagccgagaccatgccactgcactccagcctgggtgacagagtgagactccgtctggaaaaaaaaagaaaaaaatgagatataaagttcaaaggatgtatttattaagccaatataaagtaaagaggtggggaatgttgtagaagtatatgttgataaagggatcaggtggttgtacaataagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctag

SEQ ID NO: 445105 - DNA, 1132 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445106 - DNA, 377 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagacaatgtaataaaaatattattcataatttttcaat

SEQ ID NO: 445107 - DNA, 1048 bp, Homo sapiens
cataagaattcaaagaccatagaatttggtgaaatgtagtatttttacttaagtgccttttctctgcttctaccccacagccaattttttataaaccagttgataacataagtagtttttgggggatgatacattacttatacattttctatgtagtaaacatgtatgtgtatgtgtgtgggtgtgtgtctaattactttgttggacagatccctgtggaaaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtgg

SEQ ID NO: 445108 - DNA, 558 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagccttcccctaggtcttcagaagcatcaagttttaactgtggacattggatttggtggaacagcaatcatgactgttggcaagagtagcaagatgctgcatcactttttcccctgcaatgcgtcttgtgaaattgtgtagagtgtttgtgagctttttgttccctcattctgcattaataatagctaataataaatgcatagagcaattaaactgtga

SEQ ID NO: 445109 - DNA, 590 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagctttaacatgctttcctctgcaggctccatctactctttgaagcttctgcccagcttgcattgtttctaggagaacccgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatct

SEQ ID NO: 445110 - DNA, 861 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagggttagagctaatgcagcaatgatcaagaataaagaatcattaaagaatggggtgttgggggttctcttaattatcagtgacacattaatttttttccttagagcttcatacaataaacacattgcagaaagtttaagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagtt

SEQ ID NO: 445111 - DNA, 1377 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcc

SEQ ID NO: 445112 - DNA, 992 bp, Homo sapiens
agccggtacctactttccacagggaggagcggccgccggagatgcctgacgcatctgtctgaggagcggtcagtgacgcgatggagcgggcaaggagacagggtctggctatgttgcccaggttggagtgcagtgatgcagttatagctccctgtaacctcaaactcctggatcaatctagactcctgcctcagcctcccaagtgcctgttagtacaggcttgagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagggttagagctaatgcagcaatgatcaagaataaagaatcattaaagaatggggtgttgggggttctcttaattatcagtgacacattaatttttttccttagagcttcatacaataaacacattgcagaaagtttaagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagtt

SEQ ID NO: 445113 - DNA, 918 bp, Homo sapiens
ggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcag

SEQ ID NO: 445114 - DNA, 283 bp, Homo sapiens
catcttcaatagtcaaggaggacaaagacatctttcctgcaggtaaaatcattaaagactatattgtgattttgaagctgttctatttgctacgttgaggatatattagattcttatttgagttctttgaaattaaatttcttttctcatacatcctactttgtggttatgtgattattttgagtcgatattttaatcaaggactttatagttaactcttgttaataaccaacatttaatgaaatcaggcattttcttgactttagtaccacgagaagttgca

SEQ ID NO: 445115 - DNA, 1204 bp, Homo sapiens
tgatatcgagaattcgggccggcggccgctccactctgccaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445116 - DNA, 1752 bp, Homo sapiens
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggagatgtaagtgggatctgtggatctgaaaattcacagtggccagctcaccaccacctgatgaaagatacaccacagggtgagagcatcctaacagcaaactgcaaatgagatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445117 - DNA, 1089 bp, Homo sapiens
ggcacgagggctccatctactctttgaagcctggtttttgcttggaatcagattcctcgctactccaatatggctttaaccaccgctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445118 - DNA, 1346 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445119 - DNA, 5012 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacaccattatgaatggtttttgattgatctcacaaagagcatgtgctttagacattaatgcagcgactaccatgaaacagagtattggattacctaaggaaagaagcagaggatggaatttgaggcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacaggaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaagttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcacc

SEQ ID NO: 445120 - DNA, 4268 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtgg

SEQ ID NO: 445121 - DNA, 5392 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacaccattatgaatggtttttgattgatctcacaaagagcatgtgctttagacattaatgcagcgactaccatgaaacagagtattggattacctaaggaaagaagcagaggatggaatttgaggcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttt

SEQ ID NO: 445122 - DNA, 5032 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacattatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttt

SEQ ID NO: 445123 - DNA, 1341 bp, Homo sapiens
  misc_feature (1306)..(1306): n is a, c, g, or t
  misc_feature (1316)..(1316): n is a, c, g, or t
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccggcatcatgccagggagccaagcgtcctgcccggccgttgctccgactgtgtgttccaggagtggtggctctaaggtgtgaccctgcccacgtttgggcccagccaggttcagccccccaataaggagggcagcttgataacaaaaaggaaaacagtgtcaacgggtactaccangagaagaagnaaaagagttttatagcagaggtttc

SEQ ID NO: 445124 - DNA, 1124 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccaattggtgggcccatgggtggtctcataccaggtggaggagccataatgcctggaggtggggttg

SEQ ID NO: 445125 - DNA, 1477 bp, Homo sapiens
agccggtacctactttccacagggaggagcggccgccggagatgcctgacgcatctgtctgaggagcggtcagtgacgcgatggagcgggcaaggagacagggtctggctatgttgcccaggttggagtgcagtgatgcagttatagctccctgtaacctcaaactcctggatcaatctagactcctgcctcagcctcccaagtgcctgttagtacaggcttgagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445126 - DNA, 1195 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445127 - DNA, 1270 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 445128 - DNA, 972 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtccgttggtttcaacttcccggccctgtttgatggggccgtccggtggggccccgcggtagcgcccaggaagccgtcttggtttcgcgtttggccacgccgaggccccccggggccccgtttcccgtaccgcccggcgggtagccgcc

SEQ ID NO: 445129 - DNA, 896 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatacgggtggtcggacactggggagcgcgagggcgggtggaggagggtgagatccagggggaaaccccccccggaggagcgccgagggtgaccccgtagggagacggaggcgcataggccaacagagggcgcgccatccgaggaggc

SEQ ID NO: 445130 - DNA, 5141 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacggtatctcacagtccaggctggagttcagtggcattaacataactcactgcagccttgaacacctgagctcaaacgatcctttcaccttatcctccagagtagctgggactgcagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaggcttggtggtgtgtgtctgtggtcccagctactcaggaggctgaggcaggagaatcacttgaacctgggcggcaaaggttgcagtgagccgagaccatgccactgcactccagcctgggtgacagagtgagactccgtctggaaaaaaaaagaaaaaaatgagatataaagttcaaaggatgtatttattaagccaatataaagtaaagaggtggggaatgttgtagaagtatatgttgataaagggatcaggtggttgtacaataagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctag

SEQ ID NO: 445131 - DNA, 696 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaacaaagaatgcgaagcacccagagcgtgaaggttgagggccaccccccaagatactgt

SEQ ID NO: 445132 - DNA, 1894 bp, Homo sapiens
agccggtacctactttccacagggaggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggggaagcatttctccttgcattggtttgctggtatggatggcccttagattttggcatgagtgattatgcagcctatttgaagaaaacctgttttcaggacctttttaattaaatatggcctgttacatgagttaaaggcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtgg

SEQ ID NO: 445133 - DNA, 481 bp, Homo sapiens
tgagggaaggacccgtgattatccccaacacacttcagccagctggcatttcatttattgatttttattatttttattttaagacaccatctcactgtgtcacccaggccagagtgcagtggtgagaacaacgacctcccagctcaagcaatcctcccaccgcagcctcttgagtagctgggactgcaggtgtgtgccaccatgcccagctaatttttttagttttcgtagagacgagatttcaccatgttgcccaggctagtctcaaactcctgggatcaagcaatcctcccacctcgacctctcaaagtgttgggattacaggtgtgagccaccatgcatggccagctggcattttaaatgtattcaataattatcccacttattgcttttatttatttatttatttatttacttattttgagacggtgtcttgctctgtaccccaggctggagtgcgatgacatgatcttggctcact

SEQ ID NO: 445134 - DNA, 945 bp, Homo sapiens
tttttttaattttaagttagtatttcttgagaacccttattagactcagcccttttaattctcagaatagctgttagaagtaggtatgattatagtatttactgtggagcaaaccgaggcaacgaggagtattgtgttcatggtcaggaaatgacagtcacttgatcccaggtatatcagatctcaaagcccatactttttctccaggtcctggagaaagcctgagcgagggcccttgaccttaatttaagaaatttgccttgaatcccagatctttagacgtggattctaagctcacctacttggtacacctgggtaatgtggcccacagccccgttctgtgatcgtcaagatgtcatccaatcaaacgtcatgatttttttagctttcaaaccgattgtcagtgaatagaattttaggtttctaactgtcttaccttcttgatcctgtataggtaaattctcctacaggatattcttttttttcctgatttttttttctttttctgtgcttcacttgccttataagaaagatacaatggtaatatatcctccagaagtgttgtgagggttaaataagatggcgtatatgtgaaacacttggtaaatttaaatgcagcataaaggtaaggtattgttgttttttttctaggcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaa

SEQ ID NO: 445135 - DNA, 472 bp, Homo sapiens
ttttataggtatctcgcatttcccctgcttgcactcaatccatcctgctaccccatgaagaaggtgcctgcttctcctttgccttctaccacgattatgcacccagagcaacaggcagatactacactgcactatgggcttccctcatggccatgactctttcactatgtcctggcaggcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaa

SEQ ID NO: 445136 - DNA, 984 bp, Homo sapiens
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaa

SEQ ID NO: 445137 - DNA, 2817 bp, Homo sapiens
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaacaggttctttgtcttatctggggaaggaaagtataacttatatttaaatataattgcttaattaagcattatatataaacataatagtatgtcttatataattgcatgtcatattatatataataaacataaatatgtttagttatatagttagtataatttttaaaacttttaaatacagcatatggtaaaccaacgggaaaattagctattttacttcattattttaaagagttctttttatttctttcataattggatcaacaactgttaacctaaccctgggtgggcatcatgcaatatatagaagtacgtgaaattttctgtgtatgaattgctgatactttgcaaggcattttcaaatccatcaccttatgagagcttcacagctagtctgaggtagttacttcattggaggtaaaacttaaaacacaagaaagagcccacatgatttgcctagggtcattcagtaagtccgtgatggagctagaacttgttcttgtcagttttttgttctagtcttccctttcatggaggcaagaataaccattatgaaacagttagataatcataaaaatcagcatacaataaaagacttaaatgtcacaagaaaaattcaaaacctttagctaaaaaaaaaaaagatcttttgattctttttccacaagcactagatatgtttctgtgatgattttgagataagtactcaaaattacatagttcatttctaagagaaggccatgttttctacctattgggtttttctaccctgagatactatggcttctttgtaaaggtatataaagtgtttttcaaagcggaaagatactgttaaattcagctgctaatcatagtgtatttgtttggaatgacatgttgagcaggtagtacctttacggctgttgctttttgcagcattatgtggaagtgcctaagtctatttagcctcacagatgactttagaatcttgtattttctacatcagagttcatagcggggatggtgctacatatatctatgcaactgaaaaagaaaacatttcaaacctaaagtacgcaacaagatattatttatatgaaatccatagctcagttatgctatgttcatgaatagagaagttttaagttggaagggaccatggatgacccaaagcagatacatatggtcattcatatacctaaaatacctacaaagacaagttgttccctggtttaaaaggcagtctgttctattgatggactgctttagtccctgaacattttctttggttaaaccaaaaacacataaacctaacttggtcttggcttgatctactgggtaaataataactcttaaatatatatacagttgacccttggacaacacaggagttaagagcgctgaacatttgctcagtggagaatctgcatataacctgactcctcaaaaacttaattagtagttagtttacaattgactggaagccttattgataacatattgtatgtattatattccgtattcttacaagaaggtaagctagagaaaaaaaaatgttattaaggaagtaatatattcactattcgttaggtagaagtgaatcatcctaaaggtcttcatcctcatcttcacgctgagtagtctgaggagcaagaggagttggtctttctgtcccagtggcagaggtggaagaaaatccacagatacgtggacctgcgcagttcaaacctgtgttgtttgggtcaactgtattgtaatagcattttaatgtttttctcagacttttacgagtatgaatctgagctttttctgaataaacctgcctgctcaccattaataatgccaaaaaaaaat

SEQ ID NO: 445138 - DNA, 2805 bp, Homo sapiens
tttttttaattttaagttagtatttcttgagaacccttattagactcagcccttttaattctcagaatagctgttagaagtaggtatgattatagtatttactgtggagcaaaccgaggcaacgaggagtattgtgttcatggtcaggaaatgacagtcacttgatcccaggtatatcagatctcaaagcccatactttttctccaggtcctggagaaagcctgagcgagggcccttgaccttaatttaagaaatttgccttgaatcccagatctttagacgtggattctaagctcacctacttggtacacctgggtaatgtggcccacagccccgttctgtgatcgtcaagatgtcatccaatcaaacgtcatgatttttttagctttcaaaccgattgtcagtgaatagaattttaggtttctaactgtcttaccttcttgatcctgtataggtaaattctcctacaggatattcttttttttcctgatttttttttctttttctgtgcttcacttgccttataagaaagatacaatggtaatatatcctccagaagtgttgtgagggttaaataagatggcgtatatgtgaaacacttggtaaatttaaatgcagcataaaggtaaggtattgttgttttttttctaggcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaacaggttctttgtcttatctggggaaggaaagtataacttatatttaaatataattgcttaattaagcattatatataaacataatagtatgtcttatataattgcatgtcatattatatataataaacataaatatgtttagttatatagttagtataatttttaaaacttttaaatacagcatatggtaaaccaacgggaaaattagctattttacttcattattttaaagagttctttttatttctttcataattggatcaacaactgttaacctaaccctgggtgggcatcatgcaatatatagaagtacgtgaaattttctgtgtatgaattgctgatactttgcaaggcattttcaaatccatcaccttatgagagcttcacagctagtctgaggtagttacttcattggaggtaaaacttaaaacacaagaaagagcccacatgatttgcctagggtcattcagtaagtccgtgatggagctagaacttgttcttgtcagttttttgttctagtcttccctttcatggaggcaagaataaccattatgaaacagttagataatcataaaaatcagcatacaataaaagacttaaatgtcacaagaaaaattcaaaacctttagctaaaaaaaaaaaagatcttttgattctttttccacaagcactagatatgtttctgtgatgattttgagataagtactcaaaattacatagttcatttctaagagaaggccatgttttctacctattgggtttttctaccctgagatactatggcttctttgtaaaggtatataaagtgtttttcaaagcggaaagatactgttaaattcagctgctaatcatagtgtatttgtttggaatgacatgttgagcaggtagtacctttacggctgttgctttttgcagcattatgtggaagtgcctaagtctatttagcctcacagatgactttagaatcttgtattttctacatcagagttcatagcggggatggtgctacatatatctatgcaactgaaaaagaaaacatttcaaacctaaagtacgcaacaagatattatttatatgaaatccatagctcagttatgctatgttcatgaatagagaagttttaagttggaagggaccatggatgacccaaagcagatacatatggtcattcatatacctaaaatacctacaaagacaagttgttccctggtttaaaaggcagtctgttctattgatggactgctttagtccctgaacattttctttggttaaaccaaaaacacataaacctaacttggtcttggcttgatctactgggtaaataataactcttaaatatatatacagttgacccttggacaacacaggagttaagagcgctgaacatttgctcagtggagaatctgcatataacctgactcctcaaaaacttaattagtagttagtttacaattgactggaagccttattgataacataaagcagttgattaacatattttttgtgttgtatgtattatattccgtattcttacaagaaggtaagctagagaaaaaaaaatgttattaaggaagtaatatattcactattcgttaggtagaagtgaatcatcctaaaggtcttcatcctcatcttcacgctgagtagtctgaggagcaagaggagttggtctttctgtcccagtggcagaggtggaagaaaatccacagatacgtggacctgcgcagttcaaacctgtgttgtttgggtcaactgtattgtaatagcattttaatgtttttctcagacttttacgagtatgaatctgagctttttctgaataaacctgcctgctcaccattaataatgccaaaaaaaaat

SEQ ID NO: 445139 - DNA, 2264 bp, Homo sapiens
acaggcctctggataggagatatgacatgcccaaggtctcgcagttcatgtgaggcaggaaacttaagagagccagacttctttaaggagactgaaaggtgattcatttagcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaacaggttctttgtcttatctggggaaggaaagtataacttatatttaaatataattgcttaattaagcattatatataaacataatagtatgtcttatataattgcatgtcatattatatataataaacataaatatgtttagttatatagttagtataatttttaaaacttttaaatacagcatatggtaaaccaacgggaaaattagctattttacttcattattttaaagagttctttttatttctttcataattggatcaacaactgttaacctaaccctgggtgggcatcatgcaatatatagaagtacgtgaaattttctgtgtatgaattgctgatactttgcaaggcattttcaaatccatcaccttatgagagcttcacagctagtctgaggtagttacttcattggaggtaaaacttaaaacacaagaaagagcccacatgatttgcctagggtcattcagtaagtccgtgatggagctagaacttgttcttgtcagttttttgttctagtcttccctttcatggaggcaagaataaccattatgaaacagttagataatcataaaaatcagcatacaataaaagacttaaatgtcacaagaaaaattcaaaacctttagctaaaaaaaaaaaagatcttttgattctttttccacaagcactagatatgtttctgtgatgattttgagataagtactcaaaattacatagttcatttctaagagaaggccatgttttctacctattgggtttttctaccctgagatactatggcttctttgtaaaggtatataaagtgtttttcaaagcggaaagatactgttaaattcagctgctaatcatagtgtatttgtttggaatgacatgttgagcaggtagtacctttacggctgttgctttttgcagcattatgtggaagtgcctaagtctatttagcctcacagatgactttagaatcttgtattttctacatcagagttcatagcggggatggtgctacatatatctatgcaactgaaaaagaaaacatttcaaacctaaagtacgcaacaagatattatttatatgaaatccatagctcagttatgctatgttcatgaatagagaagttttaagttggaagggaccatggatgacccaaagcagatacatatggtcattcatatacctaaaatacctacaaagacaagttgttccctggtttaaaaggcagtctgttctattgatggactgctttagtccctgaacattttctttggttaaaccaaaaacacataaacctaacttggtcttggcttgatctactgggtaaataataactcttaaatatatatacagttgacccttggacaacacaggagttaagagcgctgaacatttgctcagtggagaatctgcatataacctgactcctcaaaaacttaattagtagttagtttacaattgactggaagccttattgataacataaagcagttgattaacatattttttgtgttgtatgtattatattccgtattcttacaagaaggtaagctagagaaaaaaaaatgttattaaggaagtaatatattcactattcgttaggtagaagtgaatcatcctaaaggtcttcatcctcatcttcacgctgagtagtctgaggagcaagaggagttggtctttctgtcccagtggcagaggtggaagaaaatccacagatacgtggacctgcgcagttcaaacctgtgttgtttgggtcaactgtattgtaatagcattttaatgtttttctcagacttttacgagtatgaatctgagctttttctgaataaacctgcctgctcaccattaataatgccaaaaaaaaat

SEQ ID NO: 445140 - DNA, 1256 bp, Homo sapiens
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaaaaaaaaaaaaaaaaaaaagaaaaaaaaaaaagaaaaacaaaaaaagaaaaaaaaaaaaaaaaagagaaaagaaaaaaaggggcacgaaacaagaaaaaacagcgaagaggaacaacacaagaaagaccagacaaaaaaaaagacacaacaaaaggaaaaataaaggcagaggagggaaaaaaaaaaaagagaggaaaaaaaaaataaagataataagagaaaaaatatagtagaagaaaaaaaaagtaaacaatcgaagaaaaaggactaag

SEQ ID NO: 445141 - DNA, 1309 bp, Homo sapiens
  misc_feature (987)..(988): n is a, c, g, or t
  misc_feature (993)..(994): n is a, c, g, or t
  misc_feature (996)..(996): n is a, c, g, or t
  misc_feature (1001)..(1001): n is a, c, g, or t
  misc_feature (1010)..(1011): n is a, c, g, or t
  misc_feature (1015)..(1015): n is a, c, g, or t
  misc_feature (1017)..(1017): n is a, c, g, or t
  misc_feature (1019)..(1019): n is a, c, g, or t
  misc_feature (1027)..(1027): n is a, c, g, or t
  misc_feature (1035)..(1035): n is a, c, g, or t
  misc_feature (1041)..(1042): n is a, c, g, or t
  misc_feature (1045)..(1045): n is a, c, g, or t
  misc_feature (1047)..(1047): n is a, c, g, or t
  misc_feature (1063)..(1063): n is a, c, g, or t
  misc_feature (1067)..(1068): n is a, c, g, or t
  misc_feature (1074)..(1074): n is a, c, g, or t
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaaaannacagnnanaatcnaaaaaaaannatangngntaaaattnactgaaanaaatannaananacctcgagtttttttntttnntttttnaagatttatctttgccatttttttttaaaatcttattcaaaattttaattattactttcagatttgaaaaaatttcctgcattcgtttcaggggaatttccatggcgctacccttccttattgggaaggtccactgcccgcccaagagacaggttggacggctttcttccagctttacttgctcaagccacattgctaacccggtacctgcttaacattttagggctggtttcct

SEQ ID NO: 445142 - DNA, 1016 bp, Homo sapiens
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgccacctggggtatcgttgtcatggcagaccccaaagggaaggcctaccgcgttgtttgaaagtaccaccagtgaatctgtcttctgtctctgtccctttccccgtgacacacagagcaggcatgggccatcggcgacgggggccaagccctccccgtgcccaccctctttccctgttgctgacctcaggcctgatgctggacccatgagactcccagagggaaaacacagacacagcccatccatccattgccaccttcctccagaagatcctggggacccctacccccccatcccatgaggcaccagggctgggctccc

SEQ ID NO: 445143 - DNA, 733 bp, Homo sapiens
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagtgagaatcaaggcacagcacttgggcgggttgggtatctgcg

SEQ ID NO: 445144 - DNA, 2844 bp, Homo sapiens
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaacaggttctttgtcttatctggggaaggaaagtataacttatatttaaatataattgcttaattaagcattatatataaacataatagtatgtcttatataattgcatgtcatattatatataataaacataaatatgtttagttatatagttagtataatttttaaaacttttaaatacagcatatggtaaaccaacgggaaaattagctattttacttcattattttaaagagttctttttatttctttcataattggatcaacaactgttaacctaaccctgggtgggcatcatgcaatatatagaagtacgtgaaattttctgtgtatgaattgctgatactttgcaaggcattttcaaatccatcaccttatgagagcttcacagctagtctgaggtagttacttcattggaggtaaaacttaaaacacaagaaagagcccacatgatttgcctagggtcattcagtaagtccgtgatggagctagaacttgttcttgtcagttttttgttctagtcttccctttcatggaggcaagaataaccattatgaaacagttagataatcataaaaatcagcatacaataaaagacttaaatgtcacaagaaaaattcaaaacctttagctaaaaaaaaaaaagatcttttgattctttttccacaagcactagatatgtttctgtgatgattttgagataagtactcaaaattacatagttcatttctaagagaaggccatgttttctacctattgggtttttctaccctgagatactatggcttctttgtaaaggtatataaagtgtttttcaaagcggaaagatactgttaaattcagctgctaatcatagtgtatttgtttggaatgacatgttgagcaggtagtacctttacggctgttgctttttgcagcattatgtggaagtgcctaagtctatttagcctcacagatgactttagaatcttgtattttctacatcagagttcatagcggggatggtgctacatatatctatgcaactgaaaaagaaaacatttcaaacctaaagtacgcaacaagatattatttatatgaaatccatagctcagttatgctatgttcatgaatagagaagttttaagttggaagggaccatggatgacccaaagcagatacatatggtcattcatatacctaaaatacctacaaagacaagttgttccctggtttaaaaggcagtctgttctattgatggactgctttagtccctgaacattttctttggttaaaccaaaaacacataaacctaacttggtcttggcttgatctactgggtaaataataactcttaaatatatatacagttgacccttggacaacacaggagttaagagcgctgaacatttgctcagtggagaatctgcatataacctgactcctcaaaaacttaattagtagttagtttacaattgactggaagccttattgataacataaagcagttgattaacatattttttgtgttgtatgtattatattccgtattcttacaagaaggtaagctagagaaaaaaaaatgttattaaggaagtaatatattcactattcgttaggtagaagtgaatcatcctaaaggtcttcatcctcatcttcacgctgagtagtctgaggagcaagaggagttggtctttctgtcccagtggcagaggtggaagaaaatccacagatacgtggacctgcgcagttcaaacctgtgttgtttgggtcaactgtattgtaatagcattttaatgtttttctcagacttttacgagtatgaatctgagctttttctgaataaacctgcctgctcaccattaataatgccaaaaaaaaat

SEQ ID NO: 445145 - DNA, 2758 bp, Homo sapiens
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaacaggttctttgtcttatctggggaaggaaagtataacttatatttaaatataattgcttaattaagcattatatataaacataatagtatgtcttatataattgcatgtcatattatatataataaacataaatatgtttagttatatagttagtataatttttaaaacttttaaatacagcatatggtaaaccaacgggaaaattagctattttacttcattattttaaagagttctttttatttctttcataattggatcaacaactgttaacctaaccctgggtgggcatcatgcaatatatagaagtacgtgaaattttctgtgtatgaattgctgatactttgcaaggcattttcaaatccatcaccttatgagagcttcacagctagtctgaggtagttacttcattggaggtaaaacttaaaacacaagaaagagcccacatgatttgcctagggtcattcagtaagtccgtgatggagctagaacttgttcttgtcagttttttgttctagtcttccctttcatggaggcaagaataaccattatgaaacagttagataatcataaaaatcagcatacaataaaagacttaaatgtcacaagaaaaattcaaaacctttagctaaaaaaaaaaaagatcttttgattctttttccacaagcactagatatgtttctgtgatgattttgagataagtactcaaaattacatagttcatttctaagagaaggccatgttttctacctattgggtttttctaccctgagatactatggcttctttgtaaaggtatataaagtgtttttcaaagcggaaagatactgttaaattcagctgctaatcatagtgtatttgtttggaatgacatgttgagcaggtagtacctttacggctgttgctttttgcagcattatgtggaagtgcctaagtctatttagcctcacagatgactttagaatcttgtattttctacatcagagttcatagcggggatggtgctacatatatctatgcaactgaaaaagaaaacatttcaaacctaaagtacgcaacaagatattatttatatgaaatccatagctcagttatgctatgttcatgaatagagaagttttaagttggaagggaccatggatgacccaaagcagatacatatggtcattcatatacctaaaatacctacaaagacaagttgttccctggtttaaaaggcagtctgttctattgatggactgctttagtccctgaacattttctttggttaaaccaaaaacacataaacctaacttggtcttggcttgatctactgggtaaataataactcttaaatatatatacagttgacccttggacaacacaggagttaagagcgctgaacatttgctcagtggagaatctgcatataacctgactcctcaaaaacttaattagtagttagtttacaattgactggaagccttattgataacataaagcagttgattaacatattttttgtgttgtatgtattatattccgtattcttacaagaaggtaagctagagaaaaaaaaatgttattaaggaagtaatatattcactattcgttaggtagaagtgaatcatcctaaaggtcttcatcctcatcttcacgctgagtagtctgaggagcaagaggagttggtctttctgtcccagtggcagaggtggaagaaaatccacagatacgtggacctgcgcagttcaaacctgtgttgtttgggtcaactgtattgtaatagcattttaatgtttttctcagacttttacgagtatgaatctgagctttttctgaataaacctgcctgctcaccattaataatgccaaaaaaaaat

SEQ ID NO: 445146 - DNA, 898 bp, Homo sapiens
acaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggcattgccacctggggtatcgttgtcatggcagaccccaaagggaaggcctaccgcgttgtttgaaagtaccaccagtgaatctgtcttctgtctctgtccctttccccgtgacacacagagcaggcatggaatttaatgggtgttctggacagacacttgtacatggacagacatcactactgtggatactacaagactgaaaagaaaatcgtatgttgtcattctctggctatggagtgtttgtggccttcacagatttcacaggaaccaataaatccctcagagaagtaaa

SEQ ID NO: 445147 - DNA, 622 bp, Homo sapiens
ggggatgcaacccttaaatttgcgttttttcatgaccctccctctgatttaagtacggggatactgctgacctggtgctgccttgccaccctttacatgctgtgtcatttgggttaagacatttgacaacttactaatcttctgactatgtgttcccacagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgta

SEQ ID NO: 445148 - DNA, 3181 bp, Homo sapiens
agcggaagcggaagtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgta

SEQ ID NO: 445149 - DNA, 1334 bp, Homo sapiens
cagtggtacttacaatttttatagaaactaaattttgactattttctaatgaagtctgcatacaaatgggcagaaatcagtgtcctgtcatattattccaagttaatgaggcaaactacattttccttttgtattattccattaatgaggcgaactacattttaagagctatgatagattagtaagatcatttcgtgatttggaaactgttcccttttttgttctcaaagtaattttcttcacaaatccaacttaaggttctatggttcagtccctcattttgctgaagaaccttatgccccacatggctcacccaaaaccaagctgattcttcgttgcagaacttagactgaagcctccaccgcttggccccagccccatgttcttgggtaatgctgagcttgcacctcctgtgttggggaagggctgtagggacgtggtagggccctgcagtcctgactgccgttgtctgcttccacgggccgcacagccaggccactgcaacaccaagctactcggtgtgttggcctctggacccaagctgacagctgtgagctcacaactgctccaagcttggagtcacctgttattctcagtgtgtggtcacaagtgctcatgctggaggtgagctggagaccacgtgtgtaagatgagcacacacgggctgaccctggccagatgtgaggagcatgtcaccagtcctgcagaccagtagctcagagacaagggcagcagtcacaaagggatgacatcacggcaggaaggtgggtcttgggggactttcagtagctagactggggtaaaacaccacaatgggaggacactggggaaggtgagtcagccttagagaccacagaggctgctgaatgccagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgta

SEQ ID NO: 445150 - DNA, 3445 bp, Homo sapiens
agcggaagcggaagtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccgtggctttttcctctacgtacataccatgataaagcttaacaaagaacagtgagagattaacagcaaccaataactaataaaagctatgtgaatgtggtc

SEQ ID NO: 445151 - DNA, 3342 bp, Homo sapiens
agcggaagcggaagtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccaggtaagttcatcacctgcatctccagaagaaatcagtcacatgtctgtcttaataacataaatcttccatatcaagtaccaaagtaaacagaactcagatattgaatcctgctgacctggtgccgagttaacttggtttcaaaacactcttgcttcctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgta

SEQ ID NO: 445152 - DNA, 1598 bp, Homo sapiens
cagtggtacttacaatttttatagaaactaaattttgactattttctaatgaagtctgcatacaaatgggcagaaatcagtgtcctgtcatattattccaagttaatgaggcaaactacattttccttttgtattattccattaatgaggcgaactacattttaagagctatgatagattagtaagatcatttcgtgatttggaaactgttcccttttttgttctcaaagtaattttcttcacaaatccaacttaaggttctatggttcagtccctcattttgctgaagaaccttatgccccacatggctcacccaaaaccaagctgattcttcgttgcagaacttagactgaagcctccaccgcttggccccagccccatgttcttgggtaatgctgagcttgcacctcctgtgttggggaagggctgtagggacgtggtagggccctgcagtcctgactgccgttgtctgcttccacgggccgcacagccaggccactgcaacaccaagctactcggtgtgttggcctctggacccaagctgacagctgtgagctcacaactgctccaagcttggagtcacctgttattctcagtgtgtggtcacaagtgctcatgctggaggtgagctggagaccacgtgtgtaagatgagcacacacgggctgaccctggccagatgtgaggagcatgtcaccagtcctgcagaccagtagctcagagacaagggcagcagtcacaaagggatgacatcacggcaggaaggtgggtcttgggggactttcagtagctagactggggtaaaacaccacaatgggaggacactggggaaggtgagtcagccttagagaccacagaggctgctgaatgccagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccgtggctttttcctctacgtacataccatgataaagcttaacaaagaacagtgagagattaacagcaaccaataactaataaaagctatgtgaatgtggtc

SEQ ID NO: 445153 - DNA, 391 bp, Homo sapiens
gttttcatgtctgtttactgcaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgta

SEQ ID NO: 445154 - DNA, 3251 bp, Homo sapiens
agcggaagcggaagtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacact

SEQ ID NO: 445155 - DNA, 1910 bp, Homo sapiens
agcggaagcggaagtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccgtggctttttcctctacgtacataccatgataaagcttaacaaagaacagtgagagattaacagcaaccaataactaataaaagctatgtgaatgtggtc

SEQ ID NO: 445156 - DNA, 672 bp, Homo sapiens
caatgtcaatagttctgaggtctcaacctactgcctaggtttgaatcctggctctggtacttcctaactgtgtggctttgagcacattactttacttctctgagcttcaggttccttatctgtaaaatggaattgttttgagtattaacacacacactcattatacagattttagaatagagtctggcatgtaataaatgatcagtaaaaatgagctgctgttgtagtaattcttttaaactatggagtgaatatttacctttaaaaacggataccaaatttttattatgtttaccatgtaagtgtggtgttttaaagtataaacacaataaagatcttttgacagttatgaatagtattataaattaacatttttcttgtaataaagggaacatttttgtcttggtgcttgtctttgtttcctacctttttaattgctttaaattagtgttatatttttgttcacttttttatctttttttaaatagctggggctctcagtgcacataggtatttccgagataatccttccgaattatgctgtatcattgttgatagtggatattcctttacacatatagttccttattgtagaagtaaaaagaaaaaagaagcaattattcggtgagttgtatttaattttcatgttgtttctaaagattaaacagaatg

SEQ ID NO: 445157 - DNA, 554 bp, Homo sapiens
  misc_feature (521)..(521): n is a, c, g, or t
  misc_feature (542)..(542): n is a, c, g, or t
accatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgttccttattgtagaagtaaaaagaaaaaagaagcaattattcgataaatgtgggaagactcntaaccctccatctggagatcnatatcttacggc

SEQ ID NO: 445158 - DNA, 1469 bp, Homo sapiens
accatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 445159 - DNA, 1921 bp, Homo sapiens
accatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcgtaagtactttctttctccgagggacaagatatatacgcctagtggtttcatgtgctacgtttcatctccggacatcaatgaactgcagacacccccgcgcggccctgacttagccagagggattccctggttggagctggggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 445160 - DNA, 1809 bp, Homo sapiens
caatgtcaatagttctgaggtctcaacctactgcctaggtttgaatcctggctctggtacttcctaactgtgtggctttgagcacattactttacttctctgagcttcaggttccttatctgtaaaatggaattgttttgagtattaacacacacactcattatacagattttagaatagagtctggcatgtaataaatgatcagtaaaaatgagctgctgttgtagtaattcttttaaactatggagtgaatatttacctttaaaaacggataccaaatttttattatgtttaccatgtaagtgtggtgttttaaagtataaacacaataaagatcttttgacagttatgaatagtattataaattaacatttttcttgtaataaagggaacatttttgtcttggtgcttgtctttgtttcctacctttttaattgctttaaattagtgttatatttttgttcacttttttatctttttttaaatagctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 445161 - DNA, 1687 bp, Homo sapiens
accatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 445162 - DNA, 598 bp, Homo sapiens
tgtatcattgttgatagtggatattcctttacacatatagttccttattgtagaagtaaaaagaaaaaagaagcaattattcggtgagttgtatttaattttcatgttgtttctaaagattaaacagaatgatatgtgcgataattaaatttgagttctccccttgcaggataaatgtgggaggaaaactcttaaccaatcatctaaaggagatcatatcttacaggtgatgcttagctttgattctttgggaggatggggctctggggaggaaccttttacagtaatttaagattattccttacttttaaggccagtcattgtgactcacgcctgtaatcccagcacattgggaggccgaggtgggtgcatcacttgaggccaggagttcgagaccagcctgggcaacctggtgaaaccccacttctactaaaaatacaaaaattagccaggtgtggtggtacacacctgtaatcccagctactcgggaggctgaggcatgagaatcatttgaaccaggaggtggaggttgcagtgagccgagatcgcgccacttcactccagcctgggtgacaaagtgagactctctctctctcaa

SEQ ID NO: 445163 - DNA, 1780 bp, Homo sapiens
accatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 445164 - DNA, 1720 bp, Homo sapiens
accatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 445165 - DNA, 1743 bp, Homo sapiens
accatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcagcatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 445166 - DNA, 1644 bp, Homo sapiens
accatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 445167 - DNA, 2713 bp, Homo sapiens
ggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaaggtcagtgcaggttctttgcagagaagacaagctcagggtcagtttcttggagatgcagctcagaaaggcctggcccagattctgccccagcctcaagtcagggatagctttgtgttaggacacctcagtcttctgtctctaaggccgcttgtttttaccttgttgggaaaggtgtccctggagtgaggcctcagctggctcttctgccccaagccctgtcccagtgtccccgtttctactgtccacatgagcaatgccatgggtctgatttggcgctgaacacatagggagggccaagtgtcctgcatttggtgcacccttccgccttccagtgttcccagtgcctgtgaccatgctgcaggcctgcagtggcccgctcagtacctctctcacagcacctgccatgtgccaggccaggcttggacacaggtgtgaatttgacatgcagccctcaagggggcccctccctggggcagatggaccctaggcccagttacatggtatagtcagtgctgtgtcagacacagcagaaactgctctggcatgttttgttccctctctccaaccctctgtgctgcctgtttgcctttcaacattttttgtcacgctcctcattccagtccctctggtggagaaaagcccttcatctgactttatgttctgaccagctccttgccgccttctccatccaaaccctccctagccatcccagctggcagggagtgccgcctcagatcttagggctccgagggctgaactgtgcatcttgcccgttcaagacatcatgtgctttggtccagaaatgaggtagcaaatgcaaggcacgaatcacaggcatccccagatgaggcagtgtgctcctagagggcagcttcctgcccagccatcatccttgtgttcccctgcactcagctcgtagcaggtgctccagtgtctgcttggatgcaccccaggctgggacggctcagtaagaagggtctgggctctctccctgccctgtcccatgcccttgtcctcccagagttacacagcttagggcaggctgggaacttgctgcctcttcatggggcttcctggtatctgattactaaccctcgcctgtgtcctcccaccactgccacctgtccagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaa

SEQ ID NO: 445168 - DNA, 2837 bp, Homo sapiens
tggccagatcctcaaccagacctacagcaagtttgacaccaacccgcaccaccatgacgcactgctcaacaactacggcctgctctaccgcttctgcaaggaacccacgcgcgtgggttccctccagagggaacggagccaatgaaactggcatcgtaatgctggattaaaacgttcttcccaggtttagggactcacaggctagtgagcaaaaaacagtcagcatctttccccggcagctgcctggttagtgagctctgttccatgatgggtgaggctggataggggctttcaccccagctttcttcggcagaatctggggaggaagaggcagtgccagcttccacaggcctgccttctgcacggaggatgtgggacactggctgacccgcgacatccttcaggacccctagtgctcagatgtggcccactgtcttccacaaactggggagggaggagaggcagagcaggcagcaggttcgagggttgacatcgcgttgtgtccccacaggactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaaggtcagtgcaggttctttgcagagaagacaagctcagggtcagtttcttggagatgcagctcagaaaggcctggcccagattctgccccagcctcaagtcagggatagctttgtgttaggacacctcagtcttctgtctctaaggccgcttgtttttaccttgttgggaaaggtgtccctggagtgaggcctcagctggctcttctgccccaagccctgtcccagtgtccccgtttctactgtccacatgagcaatgccatgggtctgatttggcgctgaacacatagggagggccaagtgtcctgcatttggtgcacccttccgccttccagtgttcccagtgcctgtgaccatgctgcaggcctgcagtggcccgctcagtacctctctcacagcacctgccatgtgccaggccaggcttggacacaggtgtgaatttgacatgcagccctcaagggggcccctccctggggcagatggaccctaggcccagttacatggtatagtcagtgctgtgtcagacacagcagaaactgctctggcatgttttgttccctctctccaaccctctgtgctgcctgtttgcctttcaacattttttgtcacgctcctcattccagtccctctggtggagaaaagcccttcatctgactttatgttctgaccagctccttgccgccttctccatccaaaccctccctagccatcccagctggcagggagtgccgcctcagatcttagggctccgagggctgaactgtgcatcttgcccgttcaagacatcatgtgctttggtccagaaatgaggtagcaaatgcaaggcacgaatcacaggcatccccagatgaggcagtgtgctcctagagggcagcttcctgcccagccatcatccttgtgttcccctgcactcagctcgtagcaggtgctccagtgtctgcttggatgcaccccaggctgggacggctcagtaagaagggtctgggctctctccctgccctgtcccatgcccttgtcctcccagagttacacagcttagggcaggctgggaacttgctgcctcttcatggggcttcctggtatctgattactaaccctcgcctgtgtcctcccaccactgccacctgtccagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaa

SEQ ID NO: 445169 - DNA, 1521 bp, Homo sapiens
ggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaa

SEQ ID NO: 445170 - DNA, 1536 bp, Homo sapiens
ggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaa

SEQ ID NO: 445171 - DNA, 4120 bp, Homo sapiens
ggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaaggtcagtgcaggttctttgcagagaagacaagctcagggtcagtttcttggagatgcagctcagaaaggcctggcccagattctgccccagcctcaagtcagggatagctttgtgttaggacacctcagtcttctgtctctaaggccgcttgtttttaccttgttgggaaaggtgtccctggagtgaggcctcagctggctcttctgccccaagccctgtcccagtgtccccgtttctactgtccacatgagcaatgccatgggtctgatttggcgctgaacacatagggagggccaagtgtcctgcatttggtgcacccttccgccttccagtgttcccagtgcctgtgaccatgctgcaggcctgcagtggcccgctcagtacctctctcacagcacctgccatgtgccaggccaggcttggacacaggtgtgaatttgacatgcagccctcaagggggcccctccctggggcagatggaccctaggcccagttacatggtatagtcagtgctgtgtcagacacagcagaaactgctctggcatgttttgttccctctctccaaccctctgtgctgcctgtttgcctttcaacattttttgtcacgctcctcattccagtccctctggtggagaaaagcccttcatctgactttatgttctgaccagctccttgccgccttctccatccaaaccctccctagccatcccagctggcagggagtgccgcctcagatcttagggctccgagggctgaactgtgcatcttgcccgttcaagacatcatgtgctttggtccagaaatgaggtagcaaatgcaaggcacgaatcacaggcatccccagatgaggcagtgtgctcctagagggcagcttcctgcccagccatcatccttgtgttcccctgcactcagctcgtagcaggtgctccagtgtctgcttggatgcaccccaggctgggacggctcagtaagaagggtctgggctctctccctgccctgtcccatgcccttgtcctcccagagttacacagcttagggcaggctgggaacttgctgcctcttcatggggcttcctggtatctgattactaaccctcgcctgtgtcctcccaccactgccacctgtccagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaagatttggctctatattttctttcagatttttttttttttaaggggtcttactgtcttgcgcaggctggactcctgggcttgagtggtcttcctgagggctttgcctcagctggccctcacaaccaccgtgtgtggtggaaaggcattgttcgggaaacagtcccagctcctcaggactgcaggcacccacacaccactgccgtgcccagcttctttcagatttaagtcggtaataacacccaggtgacagagcaatgtattcatatgttgagacagcatgaaagagtccattttgttttcatggaggctggaaattcattacatatggaattcttctgtatttagtgaagagatgttaatctttgagaggagccattaaaaatcggagtcacttttatccaagggaaacaaacaaaacacttgagttatgactcatatgtggcaagaggctggctggaacctcttgttgagaaacagactggggttgctatggaaactggtctcacacttcctcaccagagctcggccctcctatagaggcaacttgttttctgttatttttttttttaaattattttttgagacagggagggttccactcttgcccaggctggggtgcagtggtgtgatcccagctagtggtgtgatcccagctgactgcagcctcaagcaatcctctcagcctcctgagtagctgggaccatgggtatgcaccaccacgcttgtctttctggggttttgagatgatggcattgccatgtctctgcagaaataacttcttcaggcatatgtcagctacaaggaggcattatttaaatgaaacagtaggttctgagaaacagaagagtaggtttgggaaagttctcactcacgtgcttgtaaaaaataaagcaaactgctagcatcagagtgggcagttagcagccgcctttcagaacaggaagcaaaatgaatgaaaaattaatgcctcatgtgtcaggcattctatgggcttgtctcatttggccctcacaacaactttgtgaggtggacaagtgttattcccattgtactgatgagggaacagactcaaatcgtgatttacccaacatcacagccagtatgtagcaatctttggctcagaactcaggtctcccgtgtcaactcaggatgcctctggcagtggagcacactgctgccccttccactttttctagcacattctgaagatgcatgaagcctgagtcattcactttaaatcaagccaaaacaaagtgggcttcagtgtggacttctgagtgctagatactgagttgcccttaaaaaaaaattaacttattttaagcactgaaagctcagatttccacaaaattcagttctcaataaatcctatggctgaattctttacagacattttggaaagaatgc

SEQ ID NO: 445172 - DNA, 319 bp, Homo sapiens
aaagttatctgtttttgtggctttcaggtatagtatatcactttgtaaatcagatcaattttttggaagtgagacttggtgtgaaggagaggctatattctaaagtggtgtatatatctgtctttacattcacagtttccatcttaatatttttcctgaaaatgtcagtgcttaacacttttctcccacttcatttttgcctgcagaaaaaggagaagcgggctctagggaactggaagttgctggccaaaggtctgctcatcagggagaggctgaagcgtcgctacgggcccaaggtcagtgcaggttctttgcagag

SEQ ID NO: 445173 - DNA, 1584 bp, Homo sapiens
ggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaa

SEQ ID NO: 445174 - DNA, 2665 bp, Homo sapiens
ggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaaggtcagtgcaggttctttgcagagaagacaagctcagggtcagtttcttggagatgcagctcagaaaggcctggcccagattctgccccagcctcaagtcagggatagctttgtgttaggacacctcagtcttctgtctctaaggccgcttgtttttaccttgttgggaaaggtgtccctggagtgaggcctcagctggctcttctgccccaagccctgtcccagtgtccccgtttctactgtccacatgagcaatgccatgggtctgatttggcgctgaacacatagggagggccaagtgtcctgcatttggtgcacccttccgccttccagtgttcccagtgcctgtgaccatgctgcaggcctgcagtggcccgctcagtacctctctcacagcacctgccatgtgccaggccaggcttggacacaggtgtgaatttgacatgcagccctcaagggggcccctccctggggcagatggaccctaggcccagttacatggtatagtcagtgctgtgtcagacacagcagaaactgctctggcatgttttgttccctctctccaaccctctgtgctgcctgtttgcctttcaacattttttgtcacgctcctcattccagtccctctggtggagaaaagcccttcatctgactttatgttctgaccagctccttgccgccttctccatccaaaccctccctagccatcccagctggcagggagtgccgcctcagatcttagggctccgagggctgaactgtgcatcttgcccgttcaagacatcatgtgctttggtccagaaatgaggtagcaaatgcaaggcacgaatcacaggcatccccagatgaggcagtgtgctcctagagggcagcttcctgcccagccatcatccttgtgttcccctgcactcagctcgtagcaggtgctccagtgtctgcttggatgcaccccaggctgggacggctcagtaagaagggtctgggctctctccctgccctgtcccatgcccttgtcctcccagagttacacagcttagggcaggctgggaacttgctgcctcttcatggggcttcctggtatctgattactaaccctcgcctgtgtcctcccaccactgccacctgtccagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaa

SEQ ID NO: 445175 - DNA, 3059 bp, Homo sapiens
ggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaaggtcagtgcaggttctttgcagagaagacaagctcagggtcagtttcttggagatgcagctcagaaaggcctggcccagattctgccccagcctcaagtcagggatagctttgtgttaggacacctcagtcttctgtctctaaggccgcttgtttttaccttgttgggaaaggtgtccctggagtgaggcctcagctggctcttctgccccaagccctgtcccagtgtccccgtttctactgtccacatgagcaatgccatgggtctgatttggcgctgaacacatagggagggccaagtgtcctgcatttggtgcacccttccgccttccagtgttcccagtgcctgtgaccatgctgcaggcctgcagtggcccgctcagtacctctctcacagcacctgccatgtgccaggccaggcttggacacaggtgtgaatttgacatgcagccctcaagggggcccctccctggggcagatggaccctaggcccagttacatggtatagtcagtgctgtgtcagacacagcagaaactgctctggcatgttttgttccctctctccaaccctctgtgctgcctgtttgcctttcaacattttttgtcacgctcctcattccagtccctctggtggagaaaagcccttcatctgactttatgttctgaccagctccttgccgccttctccatccaaaccctccctagccatcccagctggcagggagtgccgcctcagatcttagggctccgagggctgaactgtgcatcttgcccgttcaagacatcatgtgctttggtccagaaatgaggtagcaaatgcaaggcacgaatcacaggcatccccagatgaggcagtgtgctcctagagggcagcttcctgcccagccatcatccttgtgttcccctgcactcagctcgtagcaggtgctccagtgtctgcttggatgcaccccaggctgggacggctcagtaagaagggtctgggctctctccctgccctgtcccatgcccttgtcctcccagagttacacagcttagggcaggctgggaacttgctgcctcttcatggggcttcctggtatctgattactaaccctcgcctgtgtcctcccaccactgccacctgtccagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaaaaaaatggaaaaaaaaaaggggggggggtataaaagatcctgggggggcccaagtaagggttaccagttttggaacaagggcctaaaggaagagcgggttttataaggccagagccaaggtgcccgacgcgtattacaaccactctcggctcggtggcaaaccctgctcccctggggaacttcgtcgagcgagaaccccagccctgcggggcggcgcacattgcggcccgcacccgcagacgattaagaggctccagcggacaataacacacaaggggtctacgtgcacaacagaacttatgtcccgcgaaaacgtctcggcatatagtagcacacgacacaacgg

SEQ ID NO: 445176 - DNA, 3727 bp, Homo sapiens
ggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaaggtcagtgcaggttctttgcagagaagacaagctcagggtcagtttcttggagatgcagctcagaaaggcctggcccagattctgccccagcctcaagtcagggatagctttgtgttaggacacctcagtcttctgtctctaaggccgcttgtttttaccttgttgggaaaggtgtccctggagtgaggcctcagctggctcttctgccccaagccctgtcccagtgtccccgtttctactgtccacatgagcaatgccatgggtctgatttggcgctgaacacatagggagggccaagtgtcctgcatttggtgcacccttccgccttccagtgttcccagtgcctgtgaccatgctgcaggcctgcagtggcccgctcagtacctctctcacagcacctgccatgtgccaggccaggcttggacacaggtgtgaatttgacatgcagccctcaagggggcccctccctggggcagatggaccctaggcccagttacatggtatagtcagtgctgtgtcagacacagcagaaactgctctggcatgttttgttccctctctccaaccctctgtgctgcctgtttgcctttcaacattttttgtcacgctcctcattccagtccctctggtggagaaaagcccttcatctgactttatgttctgaccagctccttgccgccttctccatccaaaccctccctagccatcccagctggcagggagtgccgcctcagatcttagggctccgagggctgaactgtgcatcttgcccgttcaagacatcatgtgctttggtccagaaatgaggtagcaaatgcaaggcacgaatcacaggcatccccagatgaggcagtgtgctcctagagggcagcttcctgcccagccatcatccttgtgttcccctgcactcagctcgtagcaggtgctccagtgtctgcttggatgcaccccaggctgggacggctcagtaagaagggtctgggctctctccctgccctgtcccatgcccttgtcctcccagagttacacagcttagggcaggctgggaacttgctgcctcttcatggggcttcctggtatctgattactaaccctcgcctgtgtcctcccaccactgccacctgtccagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagagggctttgcctcagctggccctcacaaccaccgtgtgtggtggaaaggcattgttcgggaaacagtcccagctcctcaggactgcaggcacccacacaccactgccgtgcccagcttctttcagatttaagtcggtaataacacccaggtgacagagcaatgtattcatatgttgagacagcatgaaagagtccattttgttttcatggaggctggaaattcattacatatggaattcttctgtatttagtgaagagatgttaatctttgagaggagccattaaaaatcggagtcacttttatccaagggaaacaaacaaaacacttgagttatgactcatatgtggcaagaggctggctggaacctcttgttgagaaacagactggggttgctatggaaactggtctcacacttcctcaccagagctcggccctcctatagaggcaacttgttttctgttatttttttttttaaattattttttgagacagggagggttccactcttgcccaggctggggtgcagtggtgtgatcccagctagtggtgtgatcccagctgactgcagcctcaagcaatcctctcagcctcctgagtagctgggaccatgggtatgcaccaccacgcttgtctttctggggttttgagatgatggcattgccatgtctctgcagaaataacttcttcaggcatatgtcagctacaaggaggcattatttaaatgaaacagtaggttctgagaaacagaagagtaggtttgggaaagttctcactcacgtgcttgtaaaaaataaagcaaactgctagcatcagagtgggcagttagcagccgcctttcagaacaggaagcaaaatgaatgaaaaattaatgcctcatgtgtcaggcattctatgggcttgtctcatttggccctcacaacaactttgtgaggtggacaagtgttattcccattgtactgatgagggaacagactcaaatcgtgatttacccaacatcacagccagtatgtagcaatctttggctcagaactcaggtctcccgtgtcaactcaggatgcctctggcagtggagcacactgctgccccttccactttttctagcacattctgaagatgcatgaagcctgagtcattcactttaaatcaagccaaaacaaagtgggcttcagtgtggacttctgagtgctagatactgagttgcccttaaaaaaaaattaacttattttaagcactgaaagctcagatttccacaaaattcagttctcaataaatcctatggctgaattctttacagacattttggaaagaatgc

SEQ ID NO: 445177 - DNA, 3778 bp, Homo sapiens
acattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctgtggattaaacttcattgacttgatggtgcgacaagggaatattgacaaccctcccaagactcccctggtgccaggatttgagtgttctgggattgttgaagctctgggggacagcgtgaaaggatatgagattggagaccgtgtcatggcatttgtcaattacaatgcctgggcagaggtggtctgcacaccagtggagtttgtctacaagatcccggatgacatgagcttctccgaggctgctgcattccccatgaacttcgtcacagcctatgtgatgctgtttgaagttgccaacctccgggaagggatgtctgtgctcgtgcactcagctggtgggggcgtgggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaagaatctctgctgaaggtgtggacatcgttttggattgcctctgtggggacaacactggaaaaggtctcagtcttctcaaacccctgggaacctacattttatatggctcatccaacatggtaactggagagaccaagagcttcttcagctttgcaaaatcatggtggcaggtggagaaggtgaaccccatcaagctgtatgaggagaacaaagtcatcgcggggttttcccttttaaatctgctcttcaaacaaggccgggcgggcctcattcggggagtggtggaaaaactcatagggctctacaaccagaagaagatcaagcctgtggtggactccttgtgggctctggaggaggtgaaggaggccatgcagcggattcacgaccgagggaacattggcaagttaattctggatgtagaaaagaccccaactccactgatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgagcatctccttccttgccaaagcatgtcccaacatgtaacaaactctagggatacaaaaggtttatattcagcatctgatgtcagatgtacagttcctcccctcccatatataaaccccggtgtagaatctgcagcgccctgctcttcggaaaccaaggaacaagccacctgctcacacaccttgttcaacttttcagctcctaaggaaccccacccccatgcaatttgactgtgcttgagaggtgaatacagttaccttcgagaaacagagggagctcctcaccccgtccttccagtccttttggctaaaatgcttaactatcactcacaaacaaatgtggagataccaggagctcatttgattcataccccaactttgtgttctgaaaaacatcagagggattttacattgcccagtttctccaccaacaagccttagggtggacccaaccctttccgcaagtggtaggaacgaatgcatcttagcaattacctgatttccaaagtccttttgtagcaaatgtcacctcattcgtggtctttttacctatcctaagcttatgatgatgagttatgtatgccaaatatttatctgaagagtttctcctcattgtgaatgtgtatgtaaaatatgaagacaagaaagggtgctttcatctgaggaaccaaggggtgggagtatcccaaaggaggacaccagcatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaactcagccacattcagaattcacatcgcctttgttatgtccagaggagaggcataaaaaggcactctcccccaccacccctaccaaatctgggtttggtttggttttatttaactagcaaagttaatccagtaatcgcaaattactccagatggttaaagaaaaccctttcagaatacagaacgagaaaactagagtttgaccaataagaccaatttctgccatgaagaaccgggggacgcaagttaattgtttaacgtactctcattttaagcaccttctttcctgtctcttgattgttttttctgaaggaagtgtaaagaatgtctcagtctgccttaaaggaactgtgaaggcttctctgtaatttaagcttgattgaagtgaactgaaacattgtctaatgtctttgtggctttagagcttttgttatattgtgcctataaagcaaattatgtttacataaaaatataaataaagtattcagcatagcaaaacctcacctggca

SEQ ID NO: 445178 - DNA, 3566 bp, Homo sapiens
acattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctgtggattaaacttcattgacttgatggtgcgacaagggaatattgacaaccctcccaagactcccctggtgccaggatttgagtgttctgggattgttgaagctctgggggacagcgtgaaaggatatgagattggagaccgtgtcatggcatttgtcaattacaatgcctgggcagaggtggtctgcacaccagtggagtttgtctacaagatcccggatgacatgagcttctccgaggctgctgcattccccatgaacttcgtcacagcctatgtgatgctgtttgaagttgccaacctccgggaagggatgtctgtgctcgtgcactcagctggtgggggcgtgggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaagaatctctgctgaaggtgtggacatcgttttggattgcctctgtggggacaacactggaaaaggtctcagtcttctcaaacccctgggaacctacattttatatggctcatccaacatggtaactggagagaccaagagcttcttcagctttgcaaaatcatggtggcaggtggagaaggtgaaccccatcaagctgtatgaggagaacaaagtcatcgcggggttttcccttttaaatctgctcttcaaacaaggccgggcgggcctcattcggggagtggtggaaaaactcatagggctctacaaccagaagaagatcaagcctgtggtggactccttgtgggctctggaggaggtgaaggaggccatgcagcggattcacgaccgagggaacattggcaagttaattctggatgtagaaaagaccccaactccactgatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgagcatctccttccttgccaaagcatgtcccaacatgtaacaaactctagggatacaaaaggtttatattcagcatctgatgtcagatgtacagttcctcccctcccatatataaaccccggtgtagaatctgcagcgccctgctcttcggaaaccaaggaacaagccacctgctcacacaccttgttcaacttttcagctcctaaggaaccccacccccatgcaatttgactgtgcttgagaggtgaatacagttaccttcgagaaacagagggagctcctcaccccgtccttccagtccttttggctaaaatgcttaactatcactcacaaacaaatgtggagataccaggagctcatttgattcataccccaactttgtgttctgaaaaacatcagagggattttacattgcccagtttctccaccaacaagccttagggtggacccaaccctttccgcaagtggtaggaacgaatgcatcttagcaattacctgatttccaaagtccttttgtagcaaatgtcacctcattcgtggtctttttacctatcctaagcttatgatgatgagttatgtatgccaaatatttatctgaagagtttctcctcattgtgaatgtgtatgtaaaatatgaagacaagaaagggtgctttcatctgaggaaccaaggggtgggagtatcccaaaggaggacaccagcatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaactcagccacattcagaattcacatcgcctttgttatgtccagaggagaggcataaaaaggcactctcccccaccacccctaccaaatctgggtttggtttggttttatttaactagcaaagttaatccagtaatcgcaaattactccagatggttaaagaaaccttagataaagagggaaactaaggttgccatagaccattttgctgaagacggggaggagtatatgtgaaggttctattagctcttcgggtggagtgtcgagaggaaaagtgcgcaaaaggaaggttttaaag

SEQ ID NO: 445179 - DNA, 3078 bp, Homo sapiens
acattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctgtggattaaacttcattgacttgatggtgcgacaagggaatattgacaaccctcccaagactcccctggtgccaggatttgagtgttctgggattgttgaagctctgggggacagcgtgaaaggatatgagattggagaccgtgtcatggcatttgtcaattacaatgcctgggcagaggtggtctgcacaccagtggagtttgtctacaagatcccggatgacatgagcttctccgaggctgctgcattccccatgaacttcgtcacagcctatgtgatgctgtttgaagttgccaacctccgggaagggatgtctgtgctcgtgcactcagctggtgggggcgtgggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaagaatctctgctgaaggtgtggacatcgttttggattgcctctgtggggacaacactggaaaaggtctcagtcttctcaaacccctgggaacctacattttatatggctcatccaacatggtaactggagagaccaagagcttcttcagctttgcaaaatcatggtggcaggtggagaaggtgaaccccatcaagctgtatgaggagaacaaagtcatcgcggggttttcccttttaaatctgctcttcaaacaaggccgggcgggcctcattcggggagtggtggaaaaactcatagggctctacaaccagaagaagatcaagcctgtggtggactccttgtgggctctggaggaggtgaaggaggccatgcagcggattcacgaccgagggaacattggcaagttaattctggatgtagaaaagaccccaactccactgatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgacatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaactcagccacattcagaattcacatcgcctttgttatgtccagaggagaggcataaaaaggcactctcccccaccacccctaccaaatctgggtttggtttggttttatttaactagcaaagttaatccagtaatcgcaaattactccagatggttaaagaaaaccctttcagaatacagaacgagaaaactagagtttgaccaataagaccaatttctgccatgaagaaccgggggacgcaagttaattgtttaacgtactctcattttaagcaccttctttcctgtctcttgattgttttttctgaaggaagtgtaaagaatgtctcagtctgccttaaaggaactgtgaaggcttctctgtaatttaagcttgattgaagtgaactgaaacattgtctaatgtctttgtggctttagagcttttgttatattgtgcctataaagcaaattatgtttacataaaaatataaataaagtattcagcatagcaaaacctcacctggca

SEQ ID NO: 445180 - DNA, 607 bp, Homo sapiens
taagaaggtaaaagtttagatttccaccattttttgtttgtttgtttttgtttttgttttgtggagcctgggcaacatagcgaaaccccatctctacaaaaaattaaccaggcactgtggcacgcacctgtagtcccagctacttgggagactgaggcaggaggatcgcttgaacccaggaggtcgaggccgcagtgagctgtgatcccaccactgcactccaggctgggtgatagaatgagatcctgtctcaaataagaaataaaaagagaaataactattttttaaatatacatgggaacagtaatctcatgtccttacttaataaagatcatgatttttcaccagggaatatagaattacactagtatgaatttcccatcacttccctccaattgtggttttctcactaagtaaaacattgctgtatttattctagacatgcagagcagttctttgaaactattctcaagttttgaacagaaagccatgctgttaaagcgccaggcttttgctgtcttcagtggagaacttgatcaataccacctttaccttccactgatacaaggtaagacagctgtcttagtctgttttttgctgttataac

SEQ ID NO: 445181 - DNA, 582 bp, Homo sapiens
cggctggatcacgaggtcacgagttcgagaccagcccggccaacatggtgaaaccccacctctactaaaaatacaaaaattagctggcattgtggcgggcacctgtaatcccagctacttgggagactgaggcaggaggatcgcttgaacccaggaggtcgaggccgcagtgagctgtgatcccaccactgcactccaggctgggtgatagaatgagatcctgtctcaaataagaaataaaaagagaaataactattttttaaatatacatgggaacagtaatctcatgtccttacttaataaagatcatgatttttcaccagggaatatagaattacactagtatgaatttcccatcacttccctccaattgtggttttctcactaagtaaaacattgctgtatttattctagacatgcagagcagttctttgaaactattctcaagttttgaacagaaagccatgctgttaaagcgccaggcttttgctgtcttcagtggagaacttgatcaataccacctttaccttccactgatacaaggtaagacagctgtcttagtctgttttttgctgttataac

SEQ ID NO: 445182 - DNA, 7581 bp, Homo sapiens
  misc_feature (4038)..(4038): n is a, c, g, or t
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctaccnctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaag

SEQ ID NO: 445183 - DNA, 7173 bp, Homo sapiens
  misc_feature (3516)..(3516): n is a, c, g, or t
acactagagagatccccttgcggtctcatatcttcacttggcaaactcaacaagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctaccnctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttcacacaaatgtc

SEQ ID NO: 445184 - DNA, 6876 bp, Homo sapiens
  misc_feature (4038)..(4038): n is a, c, g, or t
  misc_feature (6248)..(6248): n is a, c, g, or t
  misc_feature (6312)..(6312): n is a, c, g, or t
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctaccnctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggtaatacagtcccccgtcctccaaaaacttccttaaatacagatgctattgcagtgagcatgcataataaatatctggttttatttctagactactagagagccattgttcagaaaatatcttaaagttgtcataatttcttcccaaggtattgatctatgcttttccttctccagagagttaacatcttaaaatctgtgcagcgtactttgaacactttatatgagcgaagctttatgtgaggcctgttaaactttaaaaggcttggatttgcattaaattgatacagaaaaagaaaaaaaccacatatagggaagtgttaaagacctcttttagaaaaaggagaaatgggccaggcgcggtggctcacacctgcaatcccagcactttgggaggtggaggcaggcggatcacttgaggccaggagtttgagaccagcctagtcaacatggtgaaaccctatctctactaaaaatacaaaaattagtccggcatggtggcgtgcgcctgtaatcccagctactcgggaggctgaggcaggagaattgcatgaacccaggaggcggaggttgcagcgagccaagacctcaccactgctctccagcctgggtgacagagcaaggctctgtctcaaaaaaaaaaaaaaaaaaaaggcaaaatgattgtttctggtggcgttctcagtgtgccttcccatgttttatgtggagaggtatctgctttgatttgctaagttaatatatgtattaggtgtctcagctaagagagcattaaaggggattccgcaggtttttccccatggatgaaaaagaagctttactggacctcattcagatcttacaatggcngcatcccaggtgcagctctgtgttgcagaaaatgagggtgaggtggctgggtgcggtggctcancgcctgtaatcccagcactttgggaggctagagtgggtgagtcacttgaggccaggagtttgagaccagcctggccaacgtggtaaaaccctatgtctactaaaactacaaaaaattagccagggcttggtggcagcatgcctgtagtcccagtgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttcacacaaatgtc

SEQ ID NO: 445185 - DNA, 6599 bp, Homo sapiens
  misc_feature (4038)..(4038): n is a, c, g, or t
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctaccnctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcacccaccaagtaaacagaacgaaagtttcagtccggagtaatccaggtcggtttctatctacttcaaattcctccctgtacgataggacagagaaataaagcctacttcaccaagcgccttcccccgagtgtcttcttgaggtcctctaatcagccc

SEQ ID NO: 445186 - DNA, 509 bp, Homo sapiens
tccttcctgttcttcaagcccagctttcccgtggagcatcattgttctctgcagttgaaagagctctcctcttctgaactctgagcgtttgtctgtggctctaatttcttatgcatctctagtctacctatctgtattcagaaaagacactcagaatatctactgaattgatcaggaattattttcccatgtgtcttcagagctttagtttaaggttcctgttggatcctttctgggatcgtagaatttgagatcatagaacccggccatctggtccaaacccctccggctctcacgtggaacagtgaggtctgcagctgaacgtcttctccgatgtcacgcagcctgtggcctcgagagctagaacccacaccctcctgacctgtggctgctggttctcttctgagtgatataacgcaggagtttcaagattcccgggaaaggttactttcgtttttatgatcataaagagtagcctgaaaatgctagtgccgtttgatcgtttacag

SEQ ID NO: 445187 - DNA, 333 bp, Homo sapiens
aataatctggaaatcgttctgtttttcttcccattttatacctgtctggtaagtaatttgtactcttctggtaagtcactggtgtttcccaaggggtgggatatagatctcaagcagttctgtcgtacgaggacagctcagccactcatgggcattatttgctggtagccagtgaaaagtccttgttcatttttgcaaggatagcgttttcattgcacgtattgaatagcttctttccatgggtaatgtgtaaggaaccagcccattttgagatagagctttgcagaccagcaaggaagggctgcgtgtcaaaaagtcagcaatctgccctat

SEQ ID NO: 445188 - DNA, 193 bp, Homo sapiens
atgctgctgcagcttcagcaatggtgtcttcatccgccccgtcggtgtacagcgtgcaagccctctctctcctggcagaggtaaatacacacctgacctgtcgtcctttatggaaatgagcgccatcacgaattgttgcaaagacatttgttcattcccaggtgccagtgagcgtgggccgcaccctcccagg

SEQ ID NO: 445189 - DNA, 692 bp, Homo sapiens
cgtggttctgcttgtttctgcctctccggctggcttcctttcaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcaggtatttcccactgggaacactcttcttatggcctccttctccccctgagcaaaactcagaaccgtattgctggggatgggggcagtggcccacttctctgagagtgatattctatagggcactgggcagaggcagtagcctttggtcttcctctcccagcatgtaactttcaccctccaggaaagctacagtgagagcaactggggccccagtattctgggcctgccaggactgagtggaacccctgcctgggagtggggtctgggtggaggcagggagcccatgactcctccactgcactcacctggatttagcctctgccacatccagcagaggggtgggaaggtgacgtgctggtggcctgcccctcccagga

SEQ ID NO: 445190 - DNA, 7695 bp, Homo sapiens
  misc_feature (4038)..(4038): n is a, c, g, or t
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctaccnctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttcacacaaatgtc

SEQ ID NO: 445191 - DNA, 7560 bp, Homo sapiens
  misc_feature (4038)..(4038): n is a, c, g, or t
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctaccnctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaag

SEQ ID NO: 445192 - DNA, 7567 bp, Homo sapiens
  misc_feature (4038)..(4038): n is a, c, g, or t
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctaccnctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggagtgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttcacacaaatgtc

SEQ ID NO: 445193 - DNA, 5700 bp, Homo sapiens
  misc_feature (4038)..(4038): n is a, c, g, or t
  misc_feature (5419)..(5420): n is a, c, g, or t
  misc_feature (5587)..(5587): n is a, c, g, or t
  misc_feature (5591)..(5591): n is a, c, g, or t
  misc_feature (5593)..(5594): n is a, c, g, or t
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctaccnctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaagcgtcttcacccttcccccnncgacactcttccgctcccatttggcaatgtcgctgacattatgacccactagccacggctaggaaaactccaaggtaagaagtatttggatcccaagaaagaagccttgctctcaaattccttctaactctcatctaggaggagaagcaagagctcctgccctcatnggcngnnttggtgacttttccttctctgagcaaaaacgggccacatgtcactgtcatccctctcccggcaggtccagggctgccaagactggaactagcacaaaacaggggtg

SEQ ID NO: 445194 - DNA, 3348 bp, Homo sapiens
cgggagccaggccgcgcggcgccgcgccggccgagagggggccggatcccggaccatggcggcggcggggggcgccgaggggcggcgcgcggccctggaggcggcggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaacatagacatctgagc

SEQ ID NO: 445195 - DNA, 4567 bp, Homo sapiens
cgggagccaggccgcgcggcgccgcgccggccgagagggggccggatcccggaccatggcggcggcggggggcgccgaggggcggcgcgcggccctggaggcggcggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggtgagcagggcctctccctgggtcctggcctccctgtggttgtggcccttcacgtcccactctcctcacaaccggaggcacttcgggggccacctggtgcaccaatgctggggccaggcacctgggtttccatcctgtgactggggaggcttaccaggccctcctgggggtagagctggtggttgtgctggggaaaggcatgcccaggtggtgcagcacctgcctcgggggcaccttgaggggcacacgaggtgtgtgagccaggcccgtggcctgaaaatcctataaagggtacagctgtcccagggctggtctctcagaggaggggcagctcatgggctcagggctagagccaggcttctgacccaggccatgtgcacagccatggccttgcatctgtcctgggtcacgggcctggggcctggtgagtggccctgctcccggcggtgacactgaatgtcctggggccgtgggcggctctcggtgtcttcctaggcagctgctgcagcacgagtgcccgcggtgccccgagctgccacctttcagcctcttcggggacctggagcagcacatgcggaggcagcatgagctcttctgctgccgtctgtgcctccagcacctccaggtgtgcccccccagcgaccccggagagagcctaggcggtgggtggtgcaagggatgtggccacacggctgggaggggcttgtccacctgctgcttctggccccggatggccccctgagggtcaggctgcacgtggcagggaggcctctggctgctggcggggccctctcccgccccttgctgctccgccactggcctgtgggaagaggcaggaggcttggggtcccccagcctgtgcccagcctcctgtgccttgtagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccagggtgagagtatgggcgcccaggggtgaatggtgcatggtgggcgggtgcgggcagccacaggtgggtgccgggagggcaggtatggagccacggggcctgatagctgttgaccagctgtgcttccctgcacccagcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcgtaagtgtgggtgagctgcctggtgtccaccgggggtggaggaacggtaccctccccttgggccactgtgaaggctgaagcctccacctcctctttaccttctgacccccagacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacaggtcaggcgggcccggggagtccagatgggtcaggcgggcccggggcggggtgccagcccgtcttcatccagggcccgggccagaggggatgactgagtccggctctccggtggcagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttagaaacggaagactctggtagcagtccttgaaatcttgatgccattgctattttctgcattgtattgtatcttcgttttagtagtgctccaataaaaagacctgctactagcaaaaa

SEQ ID NO: 445196 - DNA, 2201 bp, Homo sapiens
  misc_feature (8)..(8): n is a, c, g, or t
  misc_feature (18)..(18): n is a, c, g, or t
  misc_feature (22)..(22): n is a, c, g, or t
aaggctangtacgaggcngggngtgaatcggccgaggctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaacatagacatctgagc

SEQ ID NO: 445197 - DNA, 1332 bp, Homo sapiens
gaagctggccctggaggccaggcagcccgcagtcagcgagggtcctctctgggtcttgtcctgccacccctcaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaacatagacatctgagc

SEQ ID NO: 445198 - DNA, 1033 bp, Homo sapiens
gctgaagcgggcctcgtcgctctgcaggaagtccctcagggacttcctgaagcgggcctcgtcgctctggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaacatagacatctgagc

SEQ ID NO: 445199 - DNA, 2514 bp, Homo sapiens
cgggagccaggccgcgcggcgccgcgccggccgagagggggccggatcccggaccatggcggcggcggggggcgccgaggggcggcgcgcggccctggaggcggcggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggacttcagcagctgtggtgctcctgaagggcacgcctgcgcaagagacagagaggggaacaggagaggggcgcagagcgggggagcgagcggagcgggaagcgaggaagggacagagacgaggaaaaagcgagaggcgaagagaacgaagaaagaaggagaagaagcagggagagagaggaagaagagagagagcggacggagcgcgagaacggaggagacgagaagagaggaagcagagaacagcacgcgcggagaagaagggagggagggaagagggagaagagaggcagggaaagagccgagagggcaggacaggagaagcaaggaggagaggacaaggcgaagacagcggagggagcagagccggcgaccgagcgaaggacgcgcagcacgagaggacgaggcgaaaggagggaaaacgg

SEQ ID NO: 445200 - DNA, 722 bp, Homo sapiens
  misc_feature (594)..(594): n is a, c, g, or t
cgggagccaggccgcgcggcgccgcgccggccgagagggggccggatcccggaccatggcggcggcggggggcgccgaggggcggcgcgcggccctggaggcggcggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagcctgctgcgaggcacgtagtgcccgcgtgtgcgcccgagctgtccacctgtatcaggtcctcttcgggagacctggagtcagacgagcatgcgtgatggcagccactgaggcatcgtatctgctgcccgttgctgatgcgcattccgagggcaaccgcattcgccaacgaagtccctgtccgaccagtaagtggacgccngcaaaacggttggggtatcctccgccggcgaatgggacgccgtggtcctctggcctatcagctatgctaggggttgtagcaccgcagatgacgacggtcgtctaccagtgtggcacccggctcttgca

SEQ ID NO: 445201 - DNA, 589 bp, Homo sapiens
cgggagccaggccgcgcggcgccgcgccggccgagagggggccggatcccggaccatggcggcggcggggggcgccgaggggcggcgcgcggcgctgccgtacgccatccctgccagaggcaggagtgccttccaggaggaggacttccccgccctggtgtcctcggtgcccaagcctggcaccgaggacaccaggctggtgctcgtgcctagcccccccgggaacacggagccacctcgtgtgaccctccaggacccgcggccatgccagccatacgacccagcacaaagaggccgacccaacacccgcaggcccacccacaccaacacctcccactccactgaagccacccgaagcacacgccaccaagcgaccgacacacccccgcaagcatcaccccagtatgcaacaaagccgagcgttccagcgaggaaaccgcaccgatggcggcagcaggaccaacgcaactcccacacgcagacgcagccatagaagaagtctcgcgacacagagaactcaagaactcccgaccccaccaccgaatcccaactcacggcccggcaggccaaccaccaggtcaggaacaaa

SEQ ID NO: 445202 - DNA, 4481 bp, Homo sapiens
cgggagccaggccgcgcggcgccgcgccggccgagagggggccggatcccggaccatggcggcggcggggggcgccgaggggcggcgcgcggccctggaggcggcggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggtgagcagggcctctccctgggtcctggcctccctgtggttgtggcccttcacgtcccactctcctcacaaccggaggcacttcgggggccacctggtgcaccaatgctggggccaggcacctgggtttccatcctgtgactggggaggcttaccaggccctcctgggggtagagctggtggttgtgctggggaaaggcatgcccaggtggtgcagcacctgcctcgggggcaccttgaggggcacacgaggtgtgtgagccaggcccgtggcctgaaaatcctataaagggtacagctgtcccagggctggtctctcagaggaggggcagctcatgggctcagggctagagccaggcttctgacccaggccatgtgcacagccatggccttgcatctgtcctgggtcacgggcctggggcctggtgagtggccctgctcccggcggtgacactgaatgtcctggggccgtgggcggctctcggtgtcttcctaggcagctgctgcagcacgagtgcccgcggtgccccgagctgccacctttcagcctcttcggggacctggagcagcacatgcggaggcagcatgagctcttctgctgccgtctgtgcctccagcacctccaggtgtgcccccccagcgaccccggagagagcctaggcggtgggtggtgcaagggatgtggccacacggctgggaggggcttgtccacctgctgcttctggccccggatggccccctgagggtcaggctgcacgtggcagggaggcctctggctgctggcggggccctctcccgccccttgctgctccgccactggcctgtgggaagaggcaggaggcttggggtcccccagcctgtgcccagcctcctgtgccttgtagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccagggtgagagtatgggcgcccaggggtgaatggtgcatggtgggcgggtgcgggcagccacaggtgggtgccgggagggcaggtatggagccacggggcctgatagctgttgaccagctgtgcttccctgcacccagcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcgtaagtgtgggtgagctgcctggtgtccaccgggggtggaggaacggtaccctccccttgggccactgtgaaggctgaagcctccacctcctctttaccttctgacccccagacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacaggtcaggcgggcccggggagtccagatgggtcaggcgggcccggggcggggtgccagcccgtcttcatccagggcccgggccagaggggatgactgagtccggctctccggtggcagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaacatagacatctgagc

SEQ ID NO: 445203 - DNA, 3366 bp, Homo sapiens
cgggagccaggccgcgcggcgccgcgccggccgagagggggccggatcccggaccatggcggcggcggggggcgccgaggggcggcgcgcggccctggaggcggcggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaacatagacatctgagc

SEQ ID NO: 445204 - DNA, 1071 bp, Homo sapiens
  misc_feature (8)..(8): n is a, c, g, or t
  misc_feature (18)..(18): n is a, c, g, or t
  misc_feature (22)..(22): n is a, c, g, or t
aaggctangtacgaggcngggngtgaatcggccgaggctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaacatagacatctgagc

SEQ ID NO: 445205 - DNA, 3131 bp, Homo sapiens
cgggagccaggccgcgcggcgccgcgccggccgagagggggccggatcccggaccatggcggcggcggggggcgccgaggggcggcgcgcggccctggaggcggcggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctgatctgggccctcccaaagctgagggctgcagcccgtggggcctcagagctgaaagctgcggcgccactggtgccagagtcagatgtcacagatgtgttgtgtaaacagttggctgtttcgtgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaacatagacatctgagc

SEQ ID NO: 445206 - DNA, 2355 bp, Homo sapiens
cgggagccaggccgcgcggcgccgcgccggccgagagggggccggatcccggaccatggcggcggcggggggcgccgaggggcggcgcgcggccctggaggcggcggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccagctccctaagggcacgcctctcccaaggatacatctagcagtcgggccgcaccatgaataaaagaggatgcttacaccggactacgacgtgaaaaaaacacgacatttaattatgcaaaactaaagatgtctatattcaaacaggatcaaagggaagtatgtgaaacatacccaaagaacatagagtacataaaaagagagagttccagctaaatattacgacaaaaaatatgatagaattaaaagatccataacaaatcaattaa

SEQ ID NO: 445207 - DNA, 538 bp, Homo sapiens
accccgccacgcagagattgatgaagaggaggaggatgtgaaacgagaacctgaagtattggtagaaagttgtgaagatggatcgagacaggaccaatgtaacctcatgaggttaaaacgatgaaacccgaaattgtagagtatttgtcatgctttagattttcagaacaaattaagaaaacaaaaaattagttcaagttccaacgaagaggcaaggtgagaaattgaagtcagtgccttaactgaggccattttaaagagaactagttaaagtcagtttgtcaaaatcaaaacttttagttttgacctagaaatttttttcttagctcttttaagaaagtttaataatttgaagttgaaaatagtttaatagcctaaaaatagtttgagataggtgagatagttgaaaataggtgaaaggttgctaagaaaataacagataataagaattacaaataccttattaaaaatataaaaatatacccaggctcacaaataattaaaggaaaggaataaaaacaatagtaatatatcattt

SEQ ID NO: 445208 - DNA, 384 bp, Homo sapiens
gagtgaggctgtggatggcaagctctcgatatttatccacaagcgggaagaccagtcatcccatgaagtcctccagccattgctaagtagttcagaaggacggcccttccgacttggtactggcgccaacatggagaaagttgtgaagatggatcgagacaggaccaatggtggctgttgcgaagtgattacagaagaggctgcagccgccctgcggaaagccaccaagtgggcacagtcaggcctcatcgtcagcattgggccacctgtagagtctatcaacccagagactgtgagtggactatccacaggcgacaaaaagaaaactgcccaaacttccatttgccgagagaggaactcggagcttgcaaggtaaaccttcca

SEQ ID NO: 445209 - DNA, 480 bp, Homo sapiens
gagtgaggctgtggatggcaagctctcgatatttatccacaagcgggaagaccagtcatcccatgaagtcctccagccattgctaaggtgaccataatgattgtgatagctacacatcctcaagcaccacccatgtcacaggcactgtgctaagtaagccctgtacatgtatcgactgcctcggccctctttacacccctttcaggtagacactgtcactgtgattcctgtggtgacacagaaagaaactgaggcagagctgaaatgcagatgtagtcttctctgaccatagaacccaagctctgaaccacaacttggtactgtctctctaagtgcaactgagagctaaagccatgtggacgatgtattattgtctatgggaagcctccagtgtgacttgggctttgagaaggaataatgccatttgatttttagttgttggcatccttcagctgttggtaaatttaggtaaactccaac

SEQ ID NO: 445210 - DNA, 147 bp, Homo sapiens
agacacttttttaaatctttaattagttgaagtatgaaatggtgtgattactcaagaagaaagtaaaaatatagtcattgcccaaatattacaaacctgcagggctttgttagtgggatccagggcaacaggaaggcttgccacata

SEQ ID NO: 445211 - DNA, 416 bp, Homo sapiens
ctgtgctaagtaagccctgtacatgtatcgactgcctcggccctctttacacccctttcaggtagacactgtcactgtgattcctgtggtgacacagaaagaaactgaggcagagctgaaatgcagatgtagtcttctctgaccatagaacccaagctctgaaccacaacttggtactgtctctctaagtgcaactgagagctaaagccatgtggacgatgtattattgtctatgggaagcctccagtgtgacttgggctttgagaaggaataatgccatttgatttttagttgttggcatccttcagctgttggtaaatttaggtaaactccaactcattgactgtgagttggagaaacaagagacacttttttaaatctttaattagttgaagtatgaaatggtgtgattactc

SEQ ID NO: 445212 - DNA, 772 bp, Homo sapiens
cgctaggtcgaggctgggtttgcggcgcaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgcaaaaaaaaaaaaaaaaaaaaataaaaaaaaaaaaagaagataaaatgaaaaaaaaaaaaaatccggggggttattttgggggggggggagaaagaggttattaagggggcggggggtaatgggttttgtggcaccttttgtttaagagggggagagatgggggggcccaaaggggggggaaaattaagggcgggtcgta

SEQ ID NO: 445213 - DNA, 1004 bp, Homo sapiens
agcctattagtaatataaccccccttaattttttcttttctgccctgagttctggcaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcaaaaaaaaaaacgaaagaacaacgactcgaaagagtaaaaaaggggcgcacgaaaagaaaagaaccccagtgaggagcacaaaaggcagcaggacccacagtagtgtggcaagagggggcccccaaagggtggcgcgacacaaaaaccggcggcgagcgcgagctgataccacagcgagacgacgcggaaacaggagtccatgggaacatcggagagacgcaccacactagtaggtgaaacaatagtggggcacacaccagcacacgataaaacgcgcaaaaggcaaataacaagaaccagcgggacaaggcggacacccgggacgatacagcagggcagcaagagggcgacaggtaagagagaacaatatccgcgg

SEQ ID NO: 445214 - DNA, 793 bp, Homo sapiens
gcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgcaaataaaaaattccaaacgtactttattttataatatatcatatttgtttgggattgttttgccttgtctatatatgtgcaaatgctcatattttatacagtagatttcctattaatatttgaatttttttttgtacctttttatgctatattttaaattgtctcttcttccctggccctcttttttgccttctactcgccacagttgcgttgtt

SEQ ID NO: 445215 - DNA, 681 bp, Homo sapiens
ctctagagtatcccccagtgaaggtgtgtcatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcaaaaaaaaaaacgaaagaacaacgactcgaaagagtaaaaaaggggcgcacgaaaagaaaagaaccccagtgaggagcacaaaaggcagcaggacccacagtagtgtggcaagagggggcccccaaagggtggcgcgacacaaaaaccggcggcgagcgcgagctgataccacagcgagacgacgcggaaacaggagtccatgggaacatcggagagacgcaccacactagtaggtgaaacaatagtggggcacacaccagcacacgataaaacgcgcaaaaggcaaataacaagaaccagcgggacaaggcggacacccgggacgatacagcagggcagcaagagggcgacaggtaagagagaacaatatccgcgg

SEQ ID NO: 445216 - DNA, 981 bp, Homo sapiens
gcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcaaaaaaaaaaacgaaagaacaacgactcgaaagagtaaaaaaggggcgcacgaaaagaaaagaaccccagtgaggagcacaaaaggcagcaggacccacagtagtgtggcaagagggggcccccaaagggtggcgcgacacaaaaaccggcggcgagcgcgagctgataccacagcgagacgacgcggaaacaggagtccatgggaacatcggagagacgcaccacactagtaggtgaaacaatagtggggcacacaccagcacacgataaaacgcgcaaaaggcaaataacaagaaccagcgggacaaggcggacacccgggacgatacagcagggcagcaagagggcgacaggtaagagagaacaatatccgcgg

SEQ ID NO: 445217 - DNA, 777 bp, Homo sapiens
gcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgcaaaaaaaaaaaaaaaaaaaaataaaaaaaaaaaaagaagataaaatgaaaaaaaaaaaaaatccggggggttattttgggggggggggagaaagaggttattaagggggcggggggtaatgggttttgtggcaccttttgtttaagagggggagagatgggggggcccaaaggggggggaaaattaagggcgggtcgta

SEQ ID NO: 445218 - DNA, 909 bp, Homo sapiens
cgctaggtcgaggctgggtttgcggcgcaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccataaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcaaaaaaaaaaacgaaagaacaacgactcgaaagagtaaaaaaggggcgcacgaaaagaaaagaaccccagtgaggagcacaaaaggcagcaggacccacagtagtgtggcaagagggggcccccaaagggtggcgcgacacaaaaaccggcggcgagcgcgagctgataccacagcgagacgacgcggaaacaggagtccatgggaacatcggagagacgcaccacactagtaggtgaaacaatagtggggcacacaccagcacacgataaaacgcgcaaaaggcaaataacaagaaccagcgggacaaggcggacacccgggacgatacagcagggcagcaagagggcgacaggtaagagagaacaatatccgcgg

SEQ ID NO: 445219 - DNA, 212 bp, Homo sapiens
cttttcttttggaaatggctacctctctcaggctcctaagcccagcaagaaaacctatagtagggcccaagctggtcagcagcagaaagcccccaggggacatggaggccagctggggttggagaagacagagatgagtcctgaggccacctgtccaggacagacacctttccctcttgctgtccagttcagggtcaaggggacaggaggcc

SEQ ID NO: 445220 - DNA, 4461 bp, Homo sapiens
ggcacgcccggaggcggggccgggtgcgtcctggcggggggattggcggagccggagagtggcagcgggcatggggcggggctgtctccagggaaacgcgacgctctccgtaggcgcagggctggcaagcagtcgggacgggagcgcgggcgtccgcggtggctgcagtcccgtcggtctccctgctgtccggcgcgagctcttcgagtcttgcttggtgcggtctcgcgacaggagcgctgggagccggggctagggggatcccggagctccgtggggcggcgggtgctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatcca

SEQ ID NO: 445221 - DNA, 483 bp, Homo sapiens
ctatttcattgagtgctttggattaacttctaatgcttcttgtggaggaatattcctgtctgtcttttttactatgaaatgtgctcctgcttgttgcaggtacttggcaaataggtccaaaagacatacactggccatgaccaaccctacagctgagatcccaccggacctacaacggcagctaggacagcagcctttccgttcccgggtctggcctcctcacctggtacctgatcagcatcggtgagtagccacatgagctgtgcgagctccttgaggctcatcggacaggcacccttctgattagtctcacagcgacggtgactagcatcgtggctttaaatagaagccagctgtcatcctgaactcacatcttctcagctccttgcagtaagcaatgcacagggcaaaggttttatactgcgccctggagcaatgcgagattcctctctcccattaccttgcagacctgtttattgtctg

SEQ ID NO: 445222 - DNA, 209 bp, Homo sapiens
accgggaagagatgcgtgaaactgggaagaagatgcagcccgtgaggctggatcatggcactgctcatgggagcagcaccatcaaattctccagcaacaaattcaagactctatctgtcctcctcagccatctccacctcttcaggctgcatgtgaaaatcagccagccctccttacccatcagctccagaggtatgagtcattttgtg

SEQ ID NO: 445223 - DNA, 6183 bp, Homo sapiens
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445224 - DNA, 6148 bp, Homo sapiens
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcttaatagctgaatgccaacaactaaaggaagaaagacaggtggaccccctgaatgaggatgtcctcttggccatggaggacatgggactggacaaagaacagacactgcaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445225 - DNA, 5243 bp, Homo sapiens
  misc_feature (8)..(8): n is a, c, g, or t
ttttcgcnaattgcccattgcaagggtcagactcttagaaggatccccatgcagttggatgttggctcctcacatctgatgccctccggccaagggggcccattccattcaacagctgtagcgtgggcggctgtaggagagactgctccttgtactcacgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445226 - DNA, 2578 bp, Homo sapiens
tcaggcgggctcaaacgggtcagagcagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445227 - DNA, 5888 bp, Homo sapiens
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggacattctgctcagctacaagcaccccgaagtctccttcagcatggagcaggcaggcgtgtaacaagaaacagagagagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445228 - DNA, 6227 bp, Homo sapiens
  misc_feature (5871)..(5871): n is a, c, g, or t
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattgctctcctctcacactctctgtgtcagcagtagaaaaaatgctggtgagactggtcgctccgtttgcgcctgctgctctactctctaatacactcttctactacccaccatgggtggtataccccatcagccctactaatatttagatactcccgtacgtacatccgtgtacaactagctgtttctgagcggaatatcgctggtacgtactaattagttggattatttacatcaatctatttccacactcatactacgagcacgacacgcaggattatttcgctggctcgaaatagcatgacgcaactgtgttctaacaccaccattaccttcatgcctctcatcatgcctcgctacgtttgctagctacggtctgccatccttctggttgctcccacgtagatatcctctctctaacggagcgactcttctgctctcactctgctcgcccacgccactctccttccaattcactgcttggcccacgctgccacccattgactgaccaaggaggtcgatcctactcttcatcccccacaccaggtctggcacacaccgcggctgcttcactgagccgccccccgcacacattacatccctcgctcgctggcaccctctctcatcaatccccccccctccctcccagtttggcttgccagcacccccgcaacacacgatcgctttccctcgtcggtcgtcgctccgttgggcagtgccgtgacagaccgcaacgctgcacttgctggcacaacgctccttcacacgcactntgacacgtccgtcctttagaacgacgacgccagtaccgcacagcacgcactcgttcacatgtacagctgagtgcacattcctacccgccgcccgctacttcattactactggccggcgccacaccggaccgacggaacccacgggtcttgcgctcccacgattccgccgccctccctactcctcgtcctgctcgatcctgtcgcgcacggccgaccaccggccgtctctcgccgcctggtcacacctccgctgctcgcctccgcgcgcgcaccccccgccgcccgtgtcttccctcctccccggactctcgcggtttcgccgtctccgcacgcaccacacccttcgtggcgacccc

SEQ ID NO: 445229 - DNA, 1282 bp, Homo sapiens
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaaaggaaaactaaccgttgcgaacggaaacaactgaccggagcagttccacttagg

SEQ ID NO: 445230 - DNA, 443 bp, Homo sapiens
aagatggaagaaaaagtttgttccataatcgtatgcatgactcaccatcatctgcatacacacactacagtagtcttttttgtttcccctgatgtgattaattgtacatcctctctgtttgggatgcagagccttggagttgtcctctacgtgcttgtgtgcggtgccctgccatttgatggaagcacactgcagaatctgcgggcccgcgtgctgagtggaaagttccgcatcccattttttatgtccacaggtaagggagtcgctagcacacagctatgaatgggttcatgaaagttagacccactcagttatcccaggaatttagtgatggagtataaatggcccacttacaaccttttttaactccagcttgctgacctgatgcctccaggaggcaaggttctgtagaaacagtatataggttttggcatcagagagcc

SEQ ID NO: 445231 - DNA, 437 bp, Homo sapiens
cctgtataacccaggagtctagaaaagttctgtaaataagaaagttaacagaaagtcctgccccaagcccagttactagagtaagaggcatgacagaataagctgccaccttgagcttttccttcctgtctctcttcaggcagtgccagcagttacccctgtggacgaggagagctcagacggggagccagaccaggaagctgtgcagaggtaatgtgacatctggcagtgcttgcagaagcccctgggcaggctcccctgcaaccagcgaaaggtcacctctgcccaaggaggtggtagagtgcagcttcaacatttgtgtggtctctttgctcaagccagatggcatgttccaccccacatggaagtaacagaagactacccagaaaatgtcatttctgtaagcaccattggaagtcccctaagtgacagcaata

SEQ ID NO: 445232 - DNA, 6363 bp, Homo sapiens
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445233 - DNA, 6219 bp, Homo sapiens
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445234 - DNA, 5178 bp, Homo sapiens
aagactcattatttctctctagtgttaaggtatgcgtgtatatgtatgtactgctttccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445235 - DNA, 6267 bp, Homo sapiens
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445236 - DNA, 2479 bp, Homo sapiens
  misc_feature (32)..(32): n is a, c, g, or t
  misc_feature (35)..(36): n is a, c, g, or t
agggggcgtaaacgtgtagaacgagcgacgangcnnatgtacagctggataacttgccaggaatgagtctcgtggctgggaaagcacttagctctgcccggatgtcggatgcagttctcagtcagtcttcgctcatgggcagccagcagtttcaggatggggaaaatgaggacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatattattatatatataatatataatatataatatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaaaaacttt

SEQ ID NO: 445237 - DNA, 2199 bp, Homo sapiens
caacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcggtgagtagccacatgagctgtgcgagctccttgaggctcatcggacaggcacccttctgattagtctcacagcgacggtgactagcatcgtggctttaaatagaagccagctgtcatcctgaactcacatcttctcagctccttgcagtaagcaatgcacagggcaaaggttttatactgcgccctggagcaatgcgagattcctctctcccattaccttgcagacctgtttattgtctg

SEQ ID NO: 445238 - DNA, 321 bp, Homo sapiens
cagagagaggcaacagcacacacagggccacagaggcatgacaactccagcatgtgcaggaaatgacagaaagtggggaatgtgctgcatgaaaaggaagtgggaggtgaagtggagagtccagtgagcggcatcctaagatcctaagactcataagccccatgccaagggatgaggactttgcctggaggaaaggcacttgggactcactgggagtgttcgaagaacaggctcaaatttgtatgttattttatttatttatttatttatttttgagacagagtcttgctctttcccccaggctggagtgcagtagcacga

SEQ ID NO: 445239 - DNA, 1519 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaaaaaaaaagggggggaaaatcaggggccaagttccgtccagtttgaagggctagggggaaaaaaaggggggggaaagggggaaagggggtttgggctttggggtggac

SEQ ID NO: 445240 - DNA, 1556 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacggtaatcccccgccccgcctgaccgcagcaggggctaacaggggtggggcggggcgggggcactgaacggagctccccggggcgctgcggggcgtggtgtggggccggcccgcagactcctccgcagagctcgcttctcccgcagcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 445241 - DNA, 1507 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaaggtgcgggcgggtttccaggggagggcagcactgggctcgattgctcgggtgaggcggacccctgccgtactgtcttcatcgccatgtccctgcagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 445242 - DNA, 1366 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgccctgacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 445243 - DNA, 1078 bp, Homo sapiens
tgaagagaggtcctaagtactggcagtggtcgggcgctgtgccgtgggagggcactcaggacctggggcggggccttttcctgccgtgggtggcacctccagggcttctcctggatggtgagcctgggcctgaccctaagagtggcctggtgggtgcaggtaggaaggtgtcaacctgccaagggcacggctggggtggggcagggggtgctgtggagatggggatattgcatctgtttctaacccacgtagccactggccacgtgactacgtaactgaggagtggaatttgtagtttgatttaactgatttaaagacgcacttgtgggtggtggcttcatctggatggggcctgcttgtgttcactctcttggcttgcaagactagggtctgaggcacaccttgtatcctccttgtagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 445244 - DNA, 169 bp, Homo sapiens
aagaaagagaagaagaagaaagacaaagagcacaggcggccagctgaggccacctcctctcccacatctcctgagaggtatgccctggtccatatctgcctcttgggggtgggggcctggttgactccttccgagtgactgactgccattggtctccccaggcccaggc

SEQ ID NO: 445245 - DNA, 1412 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 445246 - DNA, 1223 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 445247 - DNA, 1733 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggtaactccccggggtggggggcgcgtggagggccgtgggtgtggggccgactcgagcgctccctgtgctctcgcacctgcaggacttcgcggaggtctgcaagcgggaaggaggcgaccccgaggagaagggcgtggaccggctgctggggctggggagcgcaaggtgcgggcgggtttccaggggagggcagcactgggctcgattgctcgggtgaggcggacccctgccgtactgtcttcatcgccatgtccctgcagtggctccgtgggccgcgtggcgatgtcccgagaggacaaggaggccgccaaactggggctgtctgtgttcacggtaatcccccgccccgcctgaccgcagcaggggctaacaggggtggggcggggcgggggcactgaacggagctccccggggcgctgcggggcgtggtgtggggccggcccgcagactcctccgcagagctcgcttctcccgcagcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 445248 - DNA, 1218 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 445249 - DNA, 775 bp, Homo sapiens
gcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccagcccaggaggtcccagtgaggaagggatggtgcgcccccaacatggtccggagatacacccagctaccaattcgggaccaggaccaacaggaccggacccgcctccctggacctcggacctgatgaggccacgacccctgcgcttctctcctccccctgtccctcccacctgtgctcaaaataaacctctggactgaccggctaa

SEQ ID NO: 445250 - DNA, 672 bp, Homo sapiens
gatcacttgagcccaggagctcaagaccagcctggacaacagagtgagaccctgtctctacaaaatatacttaaacttagctgagcacggtggtatatgcctgtagtctcaccttcttgggaggctgatgaggcaggagtatctctgagcccaggagttggaggtttgcagtgagctacgattgtaccactgcactccagcctgggtgacaacgatgagaccctatatatatatattttttttaattaattaattagttaactatttttgagacggagtctcactctgtcgcccaggctggagtacatgagccaagatcgtgccattgcactgcggcctgggtgacagagcaagactccatctcaaaacaaaacaaaagattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccgttgtgccttaacattttctgcttgtcctttgggacaaagcagtattttactcattctttgaatgttctcattcttttgtatcatgtgacttattaaaatcagtttctaacaaactctggggcagctcatgatatgaaa

SEQ ID NO: 445251 - DNA, 459 bp, Homo sapiens
aaattagtgtgcgtggtggcgcacacctgtagtcccagctactcaggaggctgaggcaggagaattgcttgaacccaggaggtggaggttgcagtgagccaagatcgtgccattgcactgcggcctgggtgacagagcaagactccatctcaaaacaaaacaaaagattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccgttgtgccttaacattttctgcttgtcctttgggacaaagcagtattttactcattctttgaatgttctcattcttttgtatcatgtgacttattaaaatcagtttctaacaaactctggggcagctcatgatatgaaa

SEQ ID NO: 445252 - DNA, 736 bp, Homo sapiens
cctcccgccgtggcttccgcgtcgcttcccggtcagctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgaggtgggtcccacccgcatctcctcttccacaccctcctgggaccccagccctggagaagtagctctggcttgtcttctttttcattaaagataatttatgtatcgactaagaaataataaggtacattcagatgtggaaaaaaaaaaaaaaaaaaaaaaaaaaaaaaaaaaaaaaaaaagggggggggcgccaaaaaagatctcccgggggggcacacaaagtgtcagaggagacccccgagagttagtgacacaggaggtgggcccacaaaagggagagcagcaaataaaaagagccgaggcgacacgggacagacggagataaacaaacagaggggagagcgcggggagagaacagcgggcgagaccggcgggaagcacagtgagcgacggaggcaccccaaacaagcgagggagcggcaggcgcgcaaagggcgcgggcacgaaagccccacggcgcagtgtgagccgcccagggggaacacctcgcagtgacacggggtgaag

SEQ ID NO: 445253 - DNA, 417 bp, Homo sapiens
gatcacttgagcccaggagctcaagaccagcctggacaacagagtgagaccctgtctctacaaaatatacttaaacttagctgagcacggtggtatatgcctgtagtctcaccttcttgggaggctgatgaggcaggagtatctctgagcccaggagttggaggtttgcagtgagctacgattgtaccactgcactccagcctgggtgacaacgatgagaccctatatatatatattttttttaattaattaattagttaactatttttgagacggagtctcactctgtcgcccaggctggagtacagtggcatgatctcggctcactgcaacctccgcctccccagttctagtgattctcctgcctcaacctcccgagtagctgggactacaggtgtgtgccaccacacccggcta

SEQ ID NO: 445254 - DNA, 2052 bp, Homo sapiens
agaggtgggaccacggggagaggaccacggagaagtgacttttgggcccggggccatgcccgggctgtgcaaagctggccagggcctcctgtagggctcctctgcagcctgccctgccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctttggcctcttccctggacttgggtgaccagtctccgtcttcctcctgctagtgctccaccccccggacttggatgaccagtttcccaccttcctcctgctggtgctccatcccccaataccaggctgggccaccactctgaggagggtaggaggggcctccctggattgaaccgggacagaaacacggtgagggcccccaccacacctccctggttgaatcaggaatggagggagccaggcagggccctacctggggtcctgtgcccctcgttctggtctcctttgcaggcacgagataccagaaagagcatgcctttctgatagcctttggtgatgtcactgctgggaggtggctatcctgtggaccacctggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtaacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccgttgtgccttaacattttctgcttgtcctttgggacaaagcagtattttactcattctttgaatgttctcattcttttgtatcatgtgacttattaaaatcagtttct

SEQ ID NO: 445255 - DNA, 3701 bp, Homo sapiens
cctcccgccgtggcttccgcgtcgcttcccggtcagctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggaggtgcagctgaaacccaagcaccagccctacaagctgggacgccagtggccggagctgctgctgcgcttcaccagtgccccagatgatgacgtggccatggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcaagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtgtgccttcttccacggtgaggttgacaagccggcccaaggctttttgcaccggggtgggcgcaagccagtttctgtggccatcagtctggaaggcgtgcacgtcatcgatagcagagagaagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctgccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctttggcctcttccctggacttgggtgaccagtctccgtcttcctcctgctagtgctccaccccccggacttggatgaccagtttcccaccttcctcctgctggtgctccatcccccaataccaggctgggccaccactctgaggagggtaggaggggcctccctggattgaaccgggacagaaacacggtgagggcccccaccacacctccctggttgaatcaggaatggagggagccaggcagggccctacctggggtcctgtgcccctcgttctggtctcctttgcaggcacgagataccagaaagagcatgcctttctgatagcctttggtgatgtcactgctgggaggtggctatcctgtggaccacctggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtaacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccgttgtgccttaacattttctgcttgtcctttgggacaaagcagtattttactcattctttgaatgttctcattcttttgtatcatgtgacttattaaaatcagtttct

SEQ ID NO: 445256 - DNA, 3732 bp, Homo sapiens
cctcccgccgtggcttccgcgtcgcttcccggtcagctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggaggtgcagctgaaacccaagcaccagccctacaagctgggacgccagtggccggagctgctgctgcgcttcaccagtgccccagatgatgacgtggccatggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcaagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtgtgccttcttccacggtgaggttgacaagccggcccaaggctttttgcaccggggtgggcgcaagccagtttctgtggccatcagtctggaaggcgtgcacgtcatcgatagcagagagaagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctgccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctttggcctcttccctggacttgggtgaccagtctccgtcttcctcctgctagtgctccaccccccggacttggatgaccagtttcccaccttcctcctgctggtgctccatcccccaataccaggctgggccaccactctgaggagggtaggaggggcctccctggattgaaccgggacagaaacacggtgagggcccccaccacacctccctggttgaatcaggaatggagggagccaggcagggccctacctggggtcctgtgcccctcgttctggtctcctttgcaggcacgagataccagaaagagcatgcctttctgatagcctttggtgatgtcactgctgggaggtggctatcctgtggaccacctggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtaacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccgttgtgccttaacattttctgcttgtcctttgggacaaagcagtattttactcattctttgaatgttctcattcttttgtatcatgtgacttattaaaatcagtttctaacaaactctggggcagctcatgatatgaaa

SEQ ID NO: 445257 - DNA, 631 bp, Homo sapiens
caagcagaggcagcaatggttggtcctgacggtggctgagcccccagcccctggaatatgcagcccgggggagccccagacagcggcaaggacgaggtggcggagtggggcgggaggcatggtctccacctaccgggtggccgtgctgggggcgcgaggtgtgggcaagagtgccatcgtgcgccagttcttgtacaacgagttcagcgaggtctgcgtccccaccaccgcccgccgcctttacctgcctgctgtcgtcatgaacggccacgtgcacgacctccagatcctcgactttccacccatcagcgccttccctgtcaatacgctccagatggagtctccctctgtcgcccaggctggagtgcagtggcacgatctcggctcactgcaatcttcgcctcccgggttcaagcgattctcctgcctcagcctcctgagtagctggattacaggcacctgcgaccacacccagctaatttttgtatttttagtagagatggggtttcaccatgttggccaggctggtctcaaactcctgacctcaagtgatccgcctgcctaggcctcccaaagtactgggattataggcatgagccaccacgcctggtctcttatccatactttcagt

SEQ ID NO: 445258 - DNA, 2885 bp, Homo sapiens
caagcagaggcagcaatggttggtcctgacggtggctgagcccccagcccctggaatatgcagcccgggggagccccagacagcggcaaggacgaggtggcggagtggggcgggaggcatggtctccacctaccgggtggccgtgctgggggcgcgaggtgtgggcaagagtgccatcgtgcgccagttcttgtacaacgagttcagcgaggtctgcgtccccaccaccgcccgccgcctttacctgcctgctgtcgtcatgaacggccacgtgcacgacctccagatcctcgactttccacccatcagcgccttccctgtcaatacgctccaggagtgggcagacacctgctgcaggggactccggagtgtccacgcctacatcctggtctacgacatctgctgctttgacagctttgagtacgtcaagaccatccgccagcagatcctggagacgagggtgatcggaacctcagagacgcccatcatcatcgtgggcaacaagcgggacctgcagcgcggacgcgtgatcccgcgctggaacgtgtcgcacctggtacgcaagacctggaagtgcggctacgtggaatgctcggccaagtacaactggcacatcctgctgctcttcagcgagctgctcaagagcgtcggctgcgcccgttgcaagcacgtgcacgctgccctgcgcttccagggcgcgctgcgccgcaaccgctgcgccatcatgtgacgcctgcgcgcccctcgggctgcaccggcactggccgagcggagggcggggccgtactgcggggctggggcggggagcgggcgggaaatggaactgtgacggtcccggcctgaggcccctgcagccacgcacctcccggtgagaagcagagcgcgagagggagccctccgtaactgcccagccctgccccttgcccccgtggcttcctgggacagccgccttcagtgctgtatttagtgcagtgcccggcccgacccgcgggggtgccacagccttttgggatgggggtgagcgtgcaatggaggctgggggtggcgaggtgccgccttggccgggcccccacgtgtcttctccagaatgtgtctgtctttgcctggtgtcttcctttcccgtgtccgcccaccccagcgtctgttggtacttacctgtctcacctaccctccagtcccctcccagctccgctcacagggctctcatttcgtccatccccttgtcgcagatcctggcagcttctttgtgaggccaggccttctgactgtcagcaccaccggcacagggcagagatgcgggtggcccaaggaccacgatcaaggggtccgggggaccgaggtcccagatcagtgaggggagaaggttgagctctccggcttccagggagacctccccgcccagcagcccccagagacacaacaacctaccttccagccttaactcgatggtccgtccctgccaggtgcccctcactcttcctgaccccaaagccagatcaccccctgggttaaaactttttttctttttttttttggacagagtgtggaaagggagccccccaaaggatagcttctttttcatgatgccaggctccagtcctttattcccttctgcatactgcaatctgatctgtcagactggggaatgttgggttctggggtctggtcgtgggcaggatggtgcccagaagggggttaggttgtcccagtgaaaattctgttgccccgtctcaaccccatctgactaccccagactctgcctgcctcagatctcagactatcctgattaatctggggaagaacagagccagggaaagaatggtggggacccctgtacttgggggagacacacctgcatcttcctcctgccacagatggaggccctcaggatctgacaccctcttgtcccaacaccagtcagccctataccctaactcactccaccccattttctccggctgcctggccgggtttctacctctcgtcaccggagctgatcactgtcagttttgtaccgatttagaaataacaataataatgaagattctaggaatggcatgagggattgatgggggacttggagggagggacaagtggtgccctgtcccctgctcccctggccaaagaaagctgtccttgaggctgagccctcagccctggcctggtggggggacagcaaggtcccttgttataagaggggcagagaggacaactccgctttggccaacctagccaaggctgcagcatatagaccaggaaatcaggtagcccagactggtgatggagcagagtctgggggaagggtcgtgggtggggaatttatcaccaacatccattgtagggggaatctatgattctgcttccccagcggattcccactctgtccaccaagtggggggtagcacagcctcacagcaaccgccctgaccttgggcagtctagtgttcctgcattctagtccctgctgtgctgcaggactttgggcaagtgacctgccctctgtgagcctccctctgacacagaggaggtggctccccttccccacaccttagagtggctgggagggtaacaaagagggcctgcccctttagtctcctgcacccctgccccctggttcaccagagggacccaggcctctggctgctcccctgtgggagccattggaatgtatcccctgacaggcccccttccgcctccacctcaacccaggtcttggatttcaggtccctccacccccattctgagtctctgtccttctccttccacccgctcccagggtttcccaccacagggtctggaagtgtgtgtgacgcccattgagctgttacccgaagtcagattaaaaatcagggagtgttttccctcgtttctgtaaaaaaaaaatg

SEQ ID NO: 445259 - DNA, 2727 bp, Homo sapiens
caagcagaggcagcaatggttggtcctgacggtggctgagcccccagcccctggaatatgcagcccgggggagccccagacagcggcaaggacgaggtggcggagtggggcgggaggcatggtctccacctaccgggtggccgtgctgggggcgcgaggtgtgggcaagagtgccatcgtgcgccagttcttgtacaacgagttcagcgaggtctgcgtccccaccaccgcccgccgcctttacctgcctgctgtcgtcatgaacggccacgtgcacgacctccagatcctcgactttccacccatcagcgccttccctgtcaatacgctccaggagtgggcagacacctgctgcaggggactccggagtgtccacgcctacatcctggtctacgacatctgctgctttgacagctttgagtacgtcaagaccatccgccagcagatcctggagacgagggtgatcggaacctcagagacgcccatcatcatcgtgggcaacaagcgggacctgcagcgcggacgcgtgatcccgcgctggaacgtgtcgcacctggtacgcaagacctggaagtgcggctacgtggaatgctcggccaagtacaactggcacatcctgctgctcttcagcgagctgctcaagagcgtcggctgcgcccgttgcaagcacgtgcacgctgccctgcgcttccagggcgcgctgcgccgcaaccgctgcgccatcatgtgacgcctgcgcgcccctcgggctgcaccggcactggccgagcggagggcggggccgtactgcggggctggggcggggagcgggcgggaaatggaactgtgacggtcccggcctgaggcccctgcagccacgcacctcccggtgagaagcagagcgcgagagggagccctccgtaactgcccagccctgccccttgcccccgtggcttcctgggacagccgccttcagtgctgtatttagtgcagtgcccggcccgacccgcgggggtgccacagccttttgggatgggggtgagcgtgcaatggaggctgggggtggcgaggtgccgccttggccgggcccccacgtgtcttctccagaatgtgtctgtctttgcctggtgtcttcctttcccgtgtccgcccaccccagcgtctgttggtacttacctgtctcacctaccctccagtcccctcccagctccgctcacagggctctcatttcgtccatccccttgtcgcagatcctggcagcttctttgtgaggccaggccttctgactgtcagcaccaccggcacagggcagagatgcgggtggcccaaggaccacgatcaaggggtccgggggaccgaggtcccagatcagtgaggggagaaggttgagctctccggcttccagggagacctccccgcccagcagcccccagagacacaacaacctaccttccagccttaactcgatggtccgtccctgccaggtgcccctcactcttcctgaccccaaagccagatcaccccctgggttaaaactttttttctttttttttttggacagagtgtggaaagggagccccccaaaggatagcttctttttcatgatgccaggctccagtcctttattcccttctgcatactgcaatctgatctgtcagactggggaatgttgggttctggggtctggtcgtgggcaggatggtgcccagaagggggttaggttgtcccagtgaaaattctgttgccccgtctcaaccccatctgactaccccagactctgcctgcctcagatctcagactatcctgattaatctggggaagaacagagccagggaaagaatggtggggacccctgtacttgggggagacacacctgcatcttcctcctgccacagatggaggccctcaggatctgacaccctcttgtcccaacaccagtcagccctataccctaactcactccaccccattttctccggctgcctggccgggtttctacctctcgtcaccggagctgatcactgtcagttttgtaccgatttagaaataacaataataatgaagattctaggaatggcatgagggattgatgggggacttggagggagggacaagtggtgccctgtcccctgctcccctggccaaagaaagctgtccttgaggctgagccctcagccctggcctggtggggggacagcaaggtcccttgttataagaggggcagagaggacaactccgctttggccaacctagccaaggctgcagcatatagaccaggaaatcaggtagcccagactggtgatggagcagagtctgggggaagggtcgtgggtggggaatttatcaccaacatccattgtagggggaatctatgattctgcttccccagcggattcccactctgtccaccaagtggggggtagcacagcctcacagcaaccgccctgaccttgggcagtctagtgttcctgcattctagtccctgctgtgctgcaggactttgggcaagtgacctgccctctgtgagcctccctctgacacagaggaggtggctccccttccccacaccttagagtggctgggagggtaacaaagagggcctgcccctttagtctccttctccttccacccgctcccagggtttcccaccacagggtctggaagtgtgtgtgacgcccattgagctgttacccgaagtcagattaaaaatcagggagtgttttccctcgtttctgtaaaaaaaaaatg

SEQ ID NO: 445260 - DNA, 2956 bp, Homo sapiens
caagcagaggcagcaatggttggtcctgacggtggctgagcccccagcccctggaatatgcagcccgggggagccccagacagcggcaaggacgaggtggcggagtggggcgggaggcatggtctccacctaccgggtggccgtgctgggggcgcgaggtgtgggcaagagtgccatcgtgcgccagttcttgtacaacgagttcagcgaggtctgcgtccccaccaccgcccgccgcctttacctgcctgctgtcgtcatgaacggccacgtgcacgacctccagatcctcgactttccacccatcagcgccttccctgtcaatacgctccaggagtgggcagacacctgctgcaggggactccggagtgtccacgcctacatcctggtctacgacatctgctgctttgacagctttgagtacgtcaagaccatccgccagcagatcctggagacgagggtgatcggaacctcagagacgcccatcatcatcgtgggcaacaagcgggacctgcagcgcggacgcgtgatcccgcgctggaacgtgtcgcacctggtacgcaagacctggaagtgcggctacgtggaatgctcggccaagtacaactggcacatcctgctgctcttcagcgagctgctcaagagcgtcggctgcgcccgttgcaagcacgtgcacgctgccctgcgcttccagggcgcgctgcgccgcaaccgctgcgccatcatgtgacgcctgcgcgcccctcgggctgcaccggcactggccgagcggagggcggggccgtactgcggggctggggcggggagcgggcgggaaatggaactgtgacggtcccggcctgaggcccctgcagccacgcacctcccggtgagaagcagagcgcgagagggagccctccgtaactgcccagccctgccccttgcccccgtggcttcctgggacagccgccttcagtgctgtatttagtgcagtgcccggcccgacccgcgggggtgccacagccttttgggatgggggtgagcgtgcaatggaggctgggggtggcgaggtgccgccttggccgggcccccacgtgtcttctccagaatgtgtctgtctttgcctggtgtcttcctttcccgtgtccgcccaccccagcgtctgttggtacttacctgtctcacctaccctccagtcccctcccagctccgctcacagggctctcatttcgtccatccccttgtcgcagatcctggcagcttctttgtgaggccaggccttctgactgtcagcaccaccggcacagggcagagatgcgggtggcccaaggaccacgatcaaggggtccgggggaccgaggtcccagatcagtgaggggagaaggttgagctctccggcttccagggagacctccccgcccagcagcccccagagacacaacaacctaccttccagccttaactcgatggtccgtccctgccaggtgcccctcactcttcctgaccccaaagccagatcaccccctgggttaaaactttttttctttttttttttggacagagtgtggaaagggagccccccaaaggatagcttctttttcatgatgccaggctccagtcctttattcccttctgcatactgcaatctgatctgtcagactggggaatgttgggttctggggtctggtcgtgggcaggatggtgcccagaagggggttaggttgtcccagtgaaaattctgttgccccgtctcaaccccatctgactaccccagactctgcctgcctcagatctcagactatcctgattaatctggggaagaacagagccagggaaagaatggtggggacccctgtacttgggggagacacacctgcatcttcctcctgccacagatggaggccctcaggatctgacaccctcttgtcccaacaccagtcagccctataccctaactcactccaccccattttctccggctgcctggccgggtttctacctctcgtcaccggagctgatcactgtcagttttgtaccgatttagaaataacaataataatgaagattctaggaatggcatgagggattgatgggggacttggagggagggacaagtggtgccctgtcccctgctcccctggccaaagaaagctgtccttgaggctgagccctcagccctggcctggtggggggacagcaaggtcccttgttataagaggggcagagaggacaactccgctttggccaacctagccaaggctgcagcatatagaccaggaaatcaggtagcccagactggtgatggagcagagtctgggggaagggtcgtgggtggggaatttatcaccaacatccattgtagggggaatctatgattctgcttccccagcggattcccactctgtccaccaagtggggggtagcacagcctcacagcaaccgccctgaccttgggcagtctagtgttcctgcattctagtccctgctgtgctgcaggactttgggcaagtgacctgccctctgtgagcctccctctgacacagaggaggtggctccccttccccacaccttagagtggctgggagggtaacaaagagggcctgcccctttagtctcctgcacccctgccccctggttcaccagagggagcggatgaaggatggcagcatctcacatgccccatcaccaactctgaggcacctggggtgggggggcggagcccaggcctctggctgctcccctgtgggagccattggaatgtatcccctgacaggcccccttccgcctccacctcaacccaggtcttggatttcaggtccctccacccccattctgagtctctgtccttctccttccacccgctcccagggtttcccaccacagggtctggaagtgtgtgtgacgcccattgagctgttacccgaagtcagattaaaaatcagggagtgttttccctcgtttctgtaaaaaaaaaatg

SEQ ID NO: 445261 - DNA, 1003 bp, Homo sapiens
  misc_feature (75)..(75): n is a, c, g, or t
  misc_feature (84)..(85): n is a, c, g, or t
  misc_feature (88)..(89): n is a, c, g, or t
  misc_feature (102)..(102): n is a, c, g, or t
  misc_feature (109)..(109): n is a, c, g, or t
  misc_feature (123)..(123): n is a, c, g, or t
ttctgcctcttatccccggaaactagacagatacgattcgactcgtaccatcttcaaaccggaagaatagtgcgnaacatatcnncanncaccaggcattcngctccgnatatggtgtactgngagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaatttaaaaaaaaagaacatagggtacttacccaacacaaatggacagaaggattagactttctaaagactttttttgtggacattttgacatttggagaccaaggatggctcactagcccagataatagtttttctgcctggaattttttgcagtttgatttgcctgcgcctgacctcttgaaatggttatttttagaagagttgggacatttac

SEQ ID NO: 445262 - DNA, 475 bp, Homo sapiens
gaatgtatagtactagtggttaaacagagtacgaggggcacggcagcttcagaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaatttcccgaaaaaaaaacatcggccctcgctggcctaaaaaatcccgcctacgttggtctaatcgtgtggaagctctgacgaccgatttcccttctatgag

SEQ ID NO: 445263 - DNA, 854 bp, Homo sapiens
  misc_feature (75)..(75): n is a, c, g, or t
  misc_feature (84)..(85): n is a, c, g, or t
  misc_feature (88)..(89): n is a, c, g, or t
  misc_feature (102)..(102): n is a, c, g, or t
  misc_feature (109)..(109): n is a, c, g, or t
  misc_feature (123)..(123): n is a, c, g, or t
ttctgcctcttatccccggaaactagacagatacgattcgactcgtaccatcttcaaaccggaagaatagtgcgnaacatatcnncanncaccaggcattcngctccgnatatggtgtactgngagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctctt

SEQ ID NO: 445264 - DNA, 1578 bp, Homo sapiens
ctgggagtcgcccgaaggtcgctcatcctgtatagcgcacatactgacgtccaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttattttt

SEQ ID NO: 445265 - DNA, 2022 bp, Homo sapiens
cggcctcccaaagtgctgggattatgccttttctttaaaattcttggaaatagctcgtttcactgtgtatttttgtctgctcttggtacacaagtaaaatactacagaaattaatttctttcagcattgaagtgtttgctttcctctttatttcaactaagttgtaataatttctggtatcctggtaattgataactaagataatatctacagagtggatgccattaattctcttagcagtcacgtgcagaagggaagggtttgggccaacctagggttgtgctgtctctgtcgactagtctaggaaagcacccaggtgtcaggtattttggtcccttccaccacacctcagcaaatgtaaaacaagcccacagttaatggccctgtggcaaccctgccctggagaatctcaataagagcatttgaaatgaggaaagcaagatttcacatttaaatatcttgctttggcacacagttgcttttattgattaataagcaaataattataggggaactactattcatcgaatacacttattaaaatattatagcaccataaactatattggtataaaaatgttttattctttcttttgtagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttattttt

SEQ ID NO: 445266 - DNA, 792 bp, Homo sapiens
  misc_feature (75)..(75): n is a, c, g, or t
  misc_feature (84)..(85): n is a, c, g, or t
  misc_feature (88)..(89): n is a, c, g, or t
  misc_feature (102)..(102): n is a, c, g, or t
  misc_feature (109)..(109): n is a, c, g, or t
  misc_feature (123)..(123): n is a, c, g, or t
ttctgcctcttatccccggaaactagacagatacgattcgactcgtaccatcttcaaaccggaagaatagtgcgnaacatatcnncanncaccaggcattcngctccgnatatggtgtactgngagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattt

SEQ ID NO: 445267 - DNA, 1992 bp, Homo sapiens
  misc_feature (75)..(75): n is a, c, g, or t
  misc_feature (84)..(85): n is a, c, g, or t
  misc_feature (88)..(89): n is a, c, g, or t
  misc_feature (102)..(102): n is a, c, g, or t
  misc_feature (109)..(109): n is a, c, g, or t
  misc_feature (123)..(123): n is a, c, g, or t
ttctgcctcttatccccggaaactagacagatacgattcgactcgtaccatcttcaaaccggaagaatagtgcgnaacatatcnncanncaccaggcattcngctccgnatatggtgtactgngagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttattttt

SEQ ID NO: 445268 - DNA, 941 bp, Homo sapiens
  misc_feature (75)..(75): n is a, c, g, or t
  misc_feature (84)..(85): n is a, c, g, or t
  misc_feature (88)..(89): n is a, c, g, or t
  misc_feature (102)..(102): n is a, c, g, or t
  misc_feature (109)..(109): n is a, c, g, or t
  misc_feature (123)..(123): n is a, c, g, or t
ttctgcctcttatccccggaaactagacagatacgattcgactcgtaccatcttcaaaccggaagaatagtgcgnaacatatcnncanncaccaggcattcngctccgnatatggtgtactgngagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaatttttgcacaaaaaacaagaaaatgattgacatggcttcatttgtggtgttgcatgcgctgagggtcctatttctttatacactttcctcggggggtggccacgtccccattgtccctttctgcggtggggtgggactcaccaccctccttt

SEQ ID NO: 445269 - DNA, 3875 bp, Homo sapiens
ctgcccctccccccgcggccgagccggcgcgggcccccgcacctcccccgctcgcgcggcctcgagtccagaagacccgcctccacacaccggggccgccgccgcggagcctcatgggggttggagtccccaaggtttcctttgtgcgcagtattggcggggccttggactaccactcccacaaggcaccgcgcccgcctcccgcgccacgccccctcgccgctggcttccagtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatga

SEQ ID NO: 445270 - DNA, 2877 bp, Homo sapiens
gactcgagttgttctgccaatagaaataacaatccgaatattagtgtcctctgaagacgtactacactcatgagctgtcccatccctcggtttaaaaacagatgctatcccaggacgactaaaccaaacaactccaaaatccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatga

SEQ ID NO: 445271 - DNA, 2297 bp, Homo sapiens
cgacgcgctatgtcaaacagcaggctttaaaacgacggcaagtactataacggtctaaggtaagagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatga

SEQ ID NO: 445272 - DNA, 3783 bp, Homo sapiens
ctgcccctccccccgcggccgagccggcgcgggcccccgcacctcccccgctcgcgcggcctcgagtccagaagacccgcctccacacaccggggccgccgccgcggagcctcatgggggttggagtccccaaggtttcctttgtgcgcagtattggcggggccttggactaccactcccacaaggcaccgcgcccgcctcccgcgccacgccccctcgccgctggcttccagtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatga

SEQ ID NO: 445273 - DNA, 2205 bp, Homo sapiens
cgacgcgctatgtcaaacagcaggctttaaaacgacggcaagtactataacggtctaaggtaagagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatga

SEQ ID NO: 445274 - DNA, 3816 bp, Homo sapiens
ctgcccctccccccgcggccgagccggcgcgggcccccgcacctcccccgctcgcgcggcctcgagtccagaagacccgcctccacacaccggggccgccgccgcggagcctcatgggggttggagtccccaaggtttcctttgtgcgcagtattggcggggccttggactaccactcccacaaggcaccgcgcccgcctcccgcgccacgccccctcgccgctggcttccagtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagattgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatga

SEQ ID NO: 445275 - DNA, 3295 bp, Homo sapiens
ctgcccctccccccgcggccgagccggcgcgggcccccgcacctcccccgctcgcgcggcctcgagtccagaagacccgcctccacacaccggggccgccgccgcggagcctcatgggggttggagtccccaaggtttcctttgtgcgcagtattggcggggccttggactaccactcccacaaggcaccgcgcccgcctcccgcgccacgccccctcgccgctggcttccagtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggaggaggaggaggaggaataaggaggaggaggaatgccccaggaggaggaggatgcgcacaggaggagga

SEQ ID NO: 445276 - DNA, 357 bp, Homo sapiens
gttccagcttacttccttttgtttctgtgattccgcctggaagcctctccttcaaacacattcccttttctctccccttaataggaatactcccccagttgcaagaggcgcaggaccgtggaagacttcaacaaattctgcacctttgtcttggcctatgctggctacatcccttatccgaaggaggtaatcttctgagtttctgagacctttcttgatgagtagtcaaacccagtgcctccaccgcaagttcgtgggcttctgactggtcagagggtcagtaggtttggaaggggctgcttgtggtgaccccagtcactagtctggcagaaatctgtttcttgagagtttgaatta

SEQ ID NO: 445277 - DNA, 3914 bp, Homo sapiens
ctgcccctccccccgcggccgagccggcgcgggcccccgcacctcccccgctcgcgcggcctcgagtccagaagacccgcctccacacaccggggccgccgccgcggagcctcatgggggttggagtccccaaggtttcctttgtgcgcagtattggcggggccttggactaccactcccacaaggcaccgcgcccgcctcccgcgccacgccccctcgccgctggcttccagtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatgattcaaggttcaggcgattgcgttctgtgctgaaggaaaa

SEQ ID NO: 445278 - DNA, 4595 bp, Homo sapiens
ctgcccctccccccgcggccgagccggcgcgggcccccgcacctcccccgctcgcgcggcctcgagtccagaagacccgcctccacacaccggggccgccgccgcggagcctcatgggggttggagtccccaaggtttcctttgtgcgcagtattggcggggccttggactaccactcccacaaggcaccgcgcccgcctcccgcgccacgccccctcgccgctggcttccagtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatgaaaaaaaaaaaaaaaaaaaaacctccgagagtttttttttttttttttttttttttttttttttttttttttttttttttttaagaacccccccacaaaagagtggggggaacaccaccagagaagagaaaactccccacccctcttctctttcaaaaggaggcccgaaaggggggggggcgattccgacacagccagaagcgtggtgtgcgtgtgcggttgtctcacgagcagcaaaaccatcatgacggcggcggcagacaagcagcgacatgttgggagcaagaaagcgaggtgcgcgcccaaactagtcgtgggaggaatcgccgctggagagaacccgccggtggggaccaccaagaaatgggttttgggccgcccaaattgtccgcccgagaaaggatggtggaaggaggacgccccaccaaaaccctccagggggggcagtaggcgggcaggtaaactaaacaccccccccgtaatgattgcataaagaagccggcgtgacaacataaggggacgacgggagtaccaaacacacgggggggacgcgcggagatagaaccctgccagaggaacaacagcgtgtccacacaagggcacccaacgagcaaagggggagaacgccgggggacacgcccccaaagcggggggcagcagcggtggaaggcacaacatctcggaaaacctggggcaaaacgtccccgaggctgatgattgt

SEQ ID NO: 445279 - DNA, 3819 bp, Homo sapiens
ctgcccctccccccgcggccgagccggcgcgggcccccgcacctcccccgctcgcgcggcctcgagtccagaagacccgcctccacacaccggggccgccgccgcggagcctcatgggggttggagtccccaaggtttcctttgtgcgcagtattggcggggccttggactaccactcccacaaggcaccgcgcccgcctcccgcgccacgccccctcgccgctggcttccagtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgtttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatga

SEQ ID NO: 445280 - DNA, 945 bp, Homo sapiens
aattgaaacaattggaatacttttaattctactttcacaccctactctcatcccccaaaccatggggctggtggagatagttgatgtctgaaggtataaaagtaatacagctaaggatttttttaaaaaatcatttttaggcctctatagggagcaatatttaacttataatatgaaagcctattaatcagctttcagatattgagcattaaatgacatttttagggatgaagacaacagcaaagttgaatttagaccttgtcaaaatttaaggaggtctccaacattaaggtgttcccaactccccaaaagaatataagtatattcaaataatgagttagcaaagttaccaagtacaatggtgaaagaaaaaaaaagaatacctgcccataagatgttgtgaaaaaatacgaggatcaaacataaaaaaaaaaattcagatgtaaccacccacaaatcagggggccacattcacattcagccaggaaatcttaaggaggagaatttatatctaaagtggttctgggctggttgtgtagagaatataaggttaaaggatatgtacattcaaattgactttcaacttaaaagattgcctacaatccttccaaaggctccactgctcccagtttgatctgccttcatggaatcacagagatagcctatgttggaagccaaagctgtgtaataccctgactataatcatcattctcagtgctttcctttactgttattacctgagtgggaatattaccctggctgaatttggagtccctctctcaccaactgtccagccatttccaaagtgagtttaatgagtattcttatatctctagtgttagcagaagactagacaacagagtgcattgaacaggactctcctgggcaacgctggaacctcagaccagcatgggtcatttgaacccattcaatgaattagcgtct

SEQ ID NO: 445281 - DNA, 333 bp, Homo sapiens
cacaggacacacaaacaggaagagaaagatttgaagacgctacactgctggctttgaaagtggaagaaagggcaaagagaatgcaggtggcctgcagaaagtagaaaacgcaagaaaacagatttctccctacagctttcagaagaaatacaagcctgccaactccttgatttgaagacttctgactttcagaacagttagtagatttgtgttgatttaagccactgcatttatggtaattgatcactgcagccacaggaaaccaatacaggaagtcttatgactcaacccacttgacaaatgaggaaactggggatcagcaaggcacagcag

SEQ ID NO: 445282 - DNA, 727 bp, Homo sapiens
ggcggggcttccggtcgggagggtccgcccgctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacaaataaataacgaatgaacgtacgaggggaacctcctcttatttccttca

SEQ ID NO: 445283 - DNA, 759 bp, Homo sapiens
cgctccttccgctccgcccgcctggagtccttctggccggattccgcggcatccttccatagaccctcgttgttgcttcctccttgtggtaaatgttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacaaataaataacgaatgaacgtacgaggggaacctcctcttatttccttca

SEQ ID NO: 445284 - DNA, 1768 bp, Homo sapiens
ggcggggcttccggtcgggagggtccgcccgctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtaagcggggatgctgaaatcatataacctggctcatggaacatgggccttgcaaaggggtcaagatcacaaccctgcatccatgtgtgtccgtgggtaccgtaagggctactgggggaagaacctgtaagcagggtgtgaggagcacccaggctgggtagggactgcatgccccatgccacagttgaaggagggagagaacacgctgtgaaaacacagaagctcccagagaagccttctcagcttttatctctggagtagagcagactatgttgagctaacacagacctgctgaatcagcttctttctgagctgccagaagtacagaagttggagcctccaccaccttccagatctgtttctcctcagtgtaatccacctatgggttcttcctgcccactgcacagacaaaaccaattcactgcaattgtggtattgcagtagagaaagagtttaacacagagctagccaagcagaaaggctggagttattattcaactcaatctcccagagaactcagaggctacagtttctacaggcaatttggcaggcaggggctagggaatgcctgctgctgatcggctgcagacggaccatggggtgtcaacgatttttgtcccctgagtccgcctctgcgtggagccacgggatcagctgagtcatgagtctcaggtccaggtggagtctgtaggttgccagaactcaaaagtctgaaaaacatcccaaaagaccattcttaggttgtactattgacgttatcttattggggagcaattggggcggtcacaaatctcgtgacctctggctgcgtgagtcctgagcagtagggaattacagcagggcaagctggggaagcaaggcctgcgggctggttctcctcaggacacctacatctgagcagaattcaggcccctcccatcatcctaatcttgtggcccttcacaagcttcacagaggtggcttcggtcttgagcaaggaggggattcgttttagggagggatgattactattcttgatttaaagttaaactctagattaaattcctcccgtggttagcttggcctgtgcccgggactgagtggggacagccacacaagttaaactctagattaaattcctcccgcggttagcctgacccgtgcccgggactcagtggggacagccacgcaagttaaactctagattaaattcctcccgcggttagcctgacccgtgcccgggactcagtggggacagccacgcaagttagactctagattaaattcctcccgcggttagcctgacccgtgcccgggactcagtggagtcagccacacaagtta

SEQ ID NO: 445285 - DNA, 630 bp, Homo sapiens
cgctccttccgctccgcccgcctggagtccttctggccggattccgcggcatccttccatagaccctcgttgttgcttcctccttgtggtaaatgttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgaggtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacaaataaataacgaatgaacgtacgaggggaacctcctcttatttccttca

SEQ ID NO: 445286 - DNA, 431 bp, Homo sapiens
tgagccctcctcccctcctcccccttcccttcccacctcccatgcccccctttcttcctcccactcccctcccgaggccccgcttattctcccggcctgtggcggttcgtgcactcgctgagctcaggttctggtgaaggtgcccggagccgggtcccgccttcggcctgagctagagccgcgcgggcggccggcttcccccaaaccctgtgggaggggcatcccgaggaggcgaccccagagagtggggcgcggacaccttccctggggagggccagcgcgcttccttccttccagatgttccagaaggagaaggcggtgctggacgagctgggccgacgcacggggacccggctgcagcccctgacccggggcctcttcggagggagctgagggccgcgttccttctgaaagcgggacgcgggaggggt

SEQ ID NO: 445287 - DNA, 607 bp, Homo sapiens
  misc_feature (4)..(4): n is a, c, g, or t
  misc_feature (10)..(10): n is a, c, g, or t
  misc_feature (44)..(44): n is a, c, g, or t
cccnttgggnatttggcctcgaggcaaaaattcgcacgaggcgnccctttcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacaaataaataacgaatgaacgtacgaggggaacctcctcttatttccttca

SEQ ID NO: 445288 - DNA, 860 bp, Homo sapiens
ggcggggcttccggtcgggagggtccgcccgctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacaaataaataacgaatgaacgtacgaggggaacctcctcttatttccttcaaaaaacaaataaaccaaaaacacactacaccaagtcatttaagaacacaaaaaacggggcgcgccccacaaaaatcccccgggggggcgccaatttccgctacccaccttttgttaaaaagggggcccaggag

SEQ ID NO: 445289 - DNA, 463 bp, Homo sapiens
ggcggggcttccggtcgggagggtccgcccgctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacaaataaataacgaatgaacgtacgaggggaacctcctcttatttccttca

SEQ ID NO: 445290 - DNA, 384 bp, Homo sapiens
gtacgtccgggcgggtttttagtctcccaagcgagagcgtcgcattcacccgcgtgggtctgcgggcgccccagaccccagaggacccggcccccaacgcttacctgtcccctctcctgtccctcccccattccagccccttctctccccagccgttgcccctccccgcaccccgccgcgtccgcgcgcctctctccgcgcgcacccccaacccgcccccttttctctgggaaccgctccttccgctccgcccgcctggagtccttctggccggattccgcggcatccttccatagaccctcgttgttgcttcctccttgtggtaaatgtaaattcccttaagattttcaatcagttccaccaaataaagtgatctgattgcgc

SEQ ID NO: 445291 - DNA, 647 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggaggccggccgtggtggctcacgcctgtaatcccagcactttgggaggccaaggcgggtggatcacctgaggtcaggagttcgagacaacctgaccatatggtgaaaccttgtctctactaaaaaaacaaaaaatagccaggtgtggtggcgtgcgcctgtaatcccagcttctcaggaagcttgagcaagagaatcgttgaaatcttggagtttggaggtgcattaaaccaaaataccccc

SEQ ID NO: 445292 - DNA, 4237 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445293 - DNA, 3947 bp, Homo sapiens
ggtgttattgatgccaccccaatgcgctcatctgacaacctgagtggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445294 - DNA, 4198 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagactagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445295 - DNA, 3851 bp, Homo sapiens
cagactcggagaggaccatggagctctgctacaacacactgtccaacgtccttgaccatcatgccatctttggaaggacccacaccaccaccagactccagtagcgtatctcatgaccgctatcgggcagcaggagtgctaccttctgttcagcggctgcctccctgaaggaagacagcatcaaggtcttgctgcgcaactcaactaagctagaaagcctcagaggaaagctctgaagaccaggggggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445296 - DNA, 3652 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445297 - DNA, 2998 bp, Homo sapiens
tacaaatagctgacctagttaggcgggagacaggagctcgggaccatctggagacgaggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445298 - DNA, 4297 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctcaaaaaaaaagcacgcggggtgccggattgggggaaagagagtttcgcccgataatgagtg

SEQ ID NO: 445299 - DNA, 4753 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctcaaaaaagaaaacaaacaaacacaaacaatacaaaaaaaaaaaaaaaaagaaaacaaacagaagggggggggcgagcgagcgcacacaagaaaaactcaccgcaggaggaggagggcccccaaaagcatgcaccaccgcacagacgcagcgcaattcgtgcgaggaccaaacaggcgcggagacgccaaactaagggagagacagccctacagcgctccaaacacgagccgcagcaaagcgcgctcgcacggcatccaaacaaaaacagcaggccggacgcacgccggcaacccacccgccgcgcaaacgcggcaggcgagacgacccgtggacgcagaggaacgaccccccacaacaacccgggccggggcgaagcaccacaaccgcggcgcgccaacagacccaacccaacgaaagttgacaagcgcccaccccacggggcaccacatcacaacacacccgctcgacggggaccaaccaggccgctcctcacaacagacgggcaaaaaacggcag

SEQ ID NO: 445300 - DNA, 4261 bp, Homo sapiens
  misc_feature (110)..(110): n is a, c, g, or t
  misc_feature (4202)..(4202): n is a, c, g, or t
  misc_feature (4237)..(4237): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttcttggaggaaggcccncaattattaaacaacacccgggttgggcctgaacntgtgtttcccaacatagtttttcc

SEQ ID NO: 445301 - DNA, 4222 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttagggcatgggatacatgccctgcacgaagtacttgaaggcctcagcgagcttggc

SEQ ID NO: 445302 - DNA, 2087 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445303 - DNA, 1346 bp, Homo sapiens
  misc_feature (198)..(198): n is a, c, g, or t
taataactcctcgggccctgatggtagccaatcttccaagccactttcaggtacagacaactgtgggtggctgacaacaggcactttttcctctttgctgatggggacattgaggctcgtggagatgacaagacttgccgtctcctggcacagacctctttccctctgcctcaaagcctttccatgcatccacctccntggggcattctcagccatccccacagccctctgacgccagtcctgctcccaggtcaccccagccccagcttacccacctggttccttagttcagccaagatcgtctccagctcctgtactcgactcatgctgtgcaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445304 - DNA, 3385 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctggcctacagcacatgccggtaccggctcgtcactgg

SEQ ID NO: 445305 - DNA, 3373 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcggctccttctgtgtttttttctgaaccatatccatgttgctgacttttccaaataaaggttttcactcctc

SEQ ID NO: 445306 - DNA, 557 bp, Homo sapiens
ccgcaccccaacaccaagggactctgaaccagcccccagcccccggcatggatgagagcatgtcctccaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445307 - DNA, 3350 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaaaagacaccacccaaaacaacaaaaacaagagaagaccagatagacaccaaccccaatacactaagacgacctaaccccaggatgctaaaaacagacagccaaaccgaagcgaaaagcagagcgttcgcggccaggcggaagtgatcaggacgcacgaagtgagagaaaaagcagtgcagtcaaagtcacggacgtccccaaagtcctgctcaagatgtcgaatgtcactagccgaacacaggtcagaggcaataacggatactccccatcccaacaaacataacaaataaagcaatagagagacataaaacaacaaacacggggatcccaacaagacacccccaagaagccaaagcgagacatctaaaccagaaacccaaaccaagaaatcgaacagcagagcccctaaagcccatgggtggcccggttcgtatgctgagaggggacctgattatattaccaaacgaacgagccgagccgagacgataagaaaaggaacaagcccgcgaagggtccgaaggagtaggacccgcaggtagaacgaagcgcagcgtggaggacgcgactgggacgagatggcgggcgaggcgcagggtggaaagaatgtcgaacgaaagtgagccgagctaccaggtaataagtagttaaggtggccgcaacggagggctgccgaggtagcgggcggtgaaggccataacatagagagaaggatccgcaggaggcgagggaaagtgcgcgagtgtgaggccgtagggcgacgtagataagacgagtctcgggtggaagggcggagtgggcgggggcgaggagtagaggggagtcgcc

SEQ ID NO: 445308 - DNA, 1177 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445309 - DNA, 1042 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttggtaccagcgatgatggagtccactgggatcctctagaacgcc

SEQ ID NO: 445310 - DNA, 4047 bp, Homo sapiens
cgcccagcccgaacaaccgcatcgccctggtcatcactgacgggcgctcagacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445311 - DNA, 4720 bp, Homo sapiens
  misc_feature (110)..(110): n is a, c, g, or t
  misc_feature (4546)..(4546): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctcaaaaaaaaaaaacactaacaacaccaaaaaaacacattttggggggccgctttgcgcccttcgaaaaaggttttataaacaaccatttcggtttgggggcgggggcccccagaggtgtgtaatggacacccggggggccacagcggtgctcccaaaagggaaaaccggggcaagcctaggggtttcgtcttctcccaataaaaacgcgggccgcaccggcgtttgcgaaacacacccaatgggggttcggggccaactcggactctacacaggacccaggagccgattaataccaccccggggtgtatnacaatcaacacacactaacgaaacagacaagcaccaaaatacaaggaacgactaacacaatcatcaatgcaccactcaaacgtatcaacaatgagaagaacacaacacagcatcaataagaacaacatcaggaatcatagcatcatataacaaaatatacaatcacaacacaca

SEQ ID NO: 445312 - DNA, 3721 bp, Homo sapiens
gtctcacgctgccctctcctgtccaggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445313 - DNA, 3348 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445314 - DNA, 2362 bp, Homo sapiens
ggccagggcactggaggggaggggcgtgctctgctgacaccgcccccgcctgcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445315 - DNA, 2531 bp, Homo sapiens
cccgggtgttgggctgggccccgccctctttcacccataactgaaataaccaggagcaggcttgggggggtccctgctccatcattctggcccacaggccccaccctagcctggctgagcaacgccagccctgaccagccgccggacagagcagcctttacggggccatgggagggggtgggcttttctggggctgagacggggggaccccaacgtgtcagcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445316 - DNA, 2036 bp, Homo sapiens
agctcggcaccccggtgtggtgctccgccctgcgttggctctagaggtggttgagggggcgctatacgaacaataccgtcgctctgttcaacactgtcaggcgctcagacactgggagggtgaccagaacgctcaacgtgctttgaagtacccgcttccagccgtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445317 - DNA, 4611 bp, Homo sapiens
  misc_feature (110)..(110): n is a, c, g, or t
  misc_feature (4437)..(4437): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctcaaaaaaaaaaaacactaacaacaccaaaaaaacacattttggggggccgctttgcgcccttcgaaaaaggttttataaacaaccatttcggtttgggggcgggggcccccagaggtgtgtaatggacacccggggggccacagcggtgctcccaaaagggaaaaccggggcaagcctaggggtttcgtcttctcccaataaaaacgcgggccgcaccggcgtttgcgaaacacacccaatgggggttcggggccaactcggactctacacaggacccaggagccgattaataccaccccggggtgtatnacaatcaacacacactaacgaaacagacaagcaccaaaatacaaggaacgactaacacaatcatcaatgcaccactcaaacgtatcaacaatgagaagaacacaacacagcatcaataagaacaacatcaggaatcatagcatcatataacaaaatatacaatcacaacacaca

SEQ ID NO: 445318 - DNA, 4644 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctcaaaaaagaaaacaaacaaacacaaacaatacaaaaaaaaaaaaaaaaagaaaacaaacagaagggggggggcgagcgagcgcacacaagaaaaactcaccgcaggaggaggagggcccccaaaagcatgcaccaccgcacagacgcagcgcaattcgtgcgaggaccaaacaggcgcggagacgccaaactaagggagagacagccctacagcgctccaaacacgagccgcagcaaagcgcgctcgcacggcatccaaacaaaaacagcaggccggacgcacgccggcaacccacccgccgcgcaaacgcggcaggcgagacgacccgtggacgcagaggaacgaccccccacaacaacccgggccggggcgaagcaccacaaccgcggcgcgccaacagacccaacccaacgaaagttgacaagcgcccaccccacggggcaccacatcacaacacacccgctcgacggggaccaaccaggccgctcctcacaacagacgggcaaaaaacggcag

SEQ ID NO: 445319 - DNA, 1072 bp, Homo sapiens
accagctcggggttggagtgcagccagcgcccctgcgagtactctctgaggtcggggtcagtgctggtcagcagcggccttcagggctgtagggccaaggtccaggccggtcaccagcaggaccctcaggagacggggctagattttttttaaggaaaagcttggaaagccaggacacaacgctgctgcctgctttgtgcagggtcctccggggctcagccctgagttggcatcacctgcgcagggccctctgggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 445320 - DNA, 2146 bp, Homo sapiens
  misc_feature (110)..(110): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagcctgggatgaagtcaaacacgtctttgatgcccacggagaccacctggatgccggggctgcagagcacgttgagcg

SEQ ID NO: 445321 - DNA, 1098 bp, Homo sapiens
  misc_feature (110)..(110): n is a, c, g, or t
  misc_feature (1057)..(1057): n is a, c, g, or t
tccttgccctccgctctcactctggctgggagcagaaggcagcctcggtctctgggcggcggcggcggcccactctgccctggccgcgctgtgtggtgaccgcaggcccnagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccagggacncaagggctcccttttcccacttcagattgtcctgtgccgaa

SEQ ID NO: 445322 - DNA, 705 bp, Homo sapiens
tgcctggcacaggattggcacacagtagatattgtcagagatggatctgggttctgtggacaaggctgtgggggcaggtgaagagctccctcttccaggaggttgtttggggttcaaggccttgtttgggttgtaggcttctgtgctggtcagcgttgggccctacaagcgcatgccatgaggcctgcccaggatttccctcatggcctcacagaatacatcggccagagtcattaaagggcgcctgcatctgccttcagagagaggtttgaaggtagaactggggagggatgccaggtgggggttcaggtttcctgttgggtcctgatagaatcagggcaggagaggaagaagaagagggaagaggaggaacccaggcttggggaggggtggcagggcttcacaagcctggggaaggtgaactagggagcagttggggccaccatggcccagagtctatgcctcctcttccttcctgtgttcagagtgtgtgtgggaaccacaagggccttctcagtgttcatagggaagcccggttcacccatgggtgggccgcaatttgggtgccacagtgagcccctagagaccagctctcccagcttccaggacagggactaggggaggcaagagaggctcttccttaaattgtgcacccaaggtgcctcagctgccttactctagactggccccgttaactccccttaa

SEQ ID NO: 445323 - DNA, 541 bp, Homo sapiens
tgcctggcacaggattggcacacagtagatattgtcagagatggatctgggttctgtggacaaggctgtgggggcaggtgaagagctccctcttccaggaggttgtttggggttcaaggccttgtttgggttgtaggcttctgtgctggtcagcgttgggccctacaagcgcatgccatgaggcctgcccaggatttccctcatggcctcacagaatacatcggccagagtcattaaagggcgcctggggaaggtgaactagggagcagttggggccaccatggcccagagtctatgcctcctcttccttcctgtgttcagagtgtgtgtgggaaccacaagggccttctcagtgttcatagggaagcccggttcacccatgggtgggccgcaatttgggtgccacagtgagcccctagagaccagctctcccagcttccaggacagggactaggggaggcaagagaggctcttccttaaattgtgcacccaaggtgcctcagctgccttactctagactggccccgttaactccccttaa

SEQ ID NO: 445324 - DNA, 277 bp, Homo sapiens
ctcatctataatggccccagtgcctggcacaggattggcacacagtagatattgtcagagatggatctgggttctgtggacaaggctgtgggggcaggtgaagagctccctcttccaggaggttgtttggggttcaaggccttgtttgggttgtaggcttctgtgctggtcagcgttgggccctacaagcgcatgccatgaggcctgcccaggatttccctcatggcctcacagaatacatcggccagagtcattaaagggcgcctgcatctgcctt

SEQ ID NO: 445325 - DNA, 2440 bp, Homo sapiens
ggcgtggggcggggcctgggccggcgccgggtccggccgggcgctcagccagctgcgtaaactccgctggagcgcggcggcggagcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggccgagagccccacgccgcgctcctgccaggagggcaggcagggcccagaggatggagagaatactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttggagtttggtccgttgtaaatgttgacccctctccctgcatcttgggcacccctgggataacttgtgctgtgagcccaggatggaggcagtttgccctgtttgaaggaacttttaatgatctcgcctctctgc

SEQ ID NO: 445326 - DNA, 573 bp, Homo sapiens
tgcccttaacacctcaagagctgttgcaggaccagggaagataatggggtgtctagcgccgttatccgactggtcctcgaacaagctcctgtgcccagggactagaccatgactcacagctcctgtccacaccagggatcaccacgctcaccctcccctccatgtcctgcagggggcttgtgtctgaccctcctgctgcttgctgtgttcaagaaggcgctgcccgccctccccatctccatcacgttcgggctcatcttttacttcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttag

SEQ ID NO: 445327 - DNA, 3052 bp, Homo sapiens
ggcgtggggcggggcctgggccggcgccgggtccggccgggcgctcagccagctgcgtaaactccgctggagcgcggcggcggagcaggtgagcgggcggtgccggggggtgcccaggccagggccctgtcgcctgcggcgctgagggcccggggtggggctgcgccctgagggccctgccctgccctccgcacgcctctggccacggtcccttccccggctgtgggtctgcggcccctgcgtgcgcagcgctcctggcctctgcggccagcgcgggggcggagagaggagagtgcccggcaggcggcggctgggccggcccggaactgggtcgtggaaggatcgcggggagcggccctcaggccttcggcctcactgcgtccccacttccctgcgcccgcctgccgccgagccccggctgggggtgggcgcggcgcgagcggttaaagggccggtgcatttaaaggagcggtgcacgtgggtctctgaggcgtgtagcaggcgggggcgttttgttcttcttctctctcgccggagacctccgttgcgccgagtccattcggcctctagcaccgggtcctgggcatgctttccccgggaaggaggcgcgcgggggctctgcccgcacgtgaggggcagggccgcaggctcaagcctagagccggtttctgttagcagcggtgtttggctgttttatcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggccgagagccccacgccgcgctcctgccaggagggcaggcagggcccagaggatggagagaatactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttggagtttggtccgttgtaaatgttgacccctctccctgcatcttgggcacccctgggataacttgtgctgtgagcccaggatggaggcagtttgccctgtttgaaggaacttttaatgatctcgcctctctgc

SEQ ID NO: 445328 - DNA, 3190 bp, Homo sapiens
ggcgtggggcggggcctgggccggcgccgggtccggccgggcgctcagccagctgcgtaaactccgctggagcgcggcggcggagcaggtgagcgggcggtgccggggggtgcccaggccagggccctgtcgcctgcggcgctgagggcccggggtggggctgcgccctgagggccctgccctgccctccgcacgcctctggccacggtcccttccccggctgtgggtctgcggcccctgcgtgcgcagcgctcctggcctctgcggccagcgcgggggcggagagaggagagtgcccggcaggcggcggctgggccggcccggaactgggtcgtggaaggatcgcggggagcggccctcaggccttcggcctcactgcgtccccacttccctgcgcccgcctgccgccgagccccggctgggggtgggcgcggcgcgagcggttaaagggccggtgcatttaaaggagcggtgcacgtgggtctctgaggcgtgtagcaggcgggggcgttttgttcttcttctctctcgccggagacctccgttgcgccgagtccattcggcctctagcaccgggtcctgggcatgctttccccgggaaggaggcgcgcgggggctctgcccgcacgtgaggggcagggccgcaggctcaagcctagagccggtttctgttagcagcggtgtttggctgttttatcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtgggtgtgaagctcagccctgagggtctctggacagcgatcactcagcctctggacagcgatcactcagcctctggacagacagcgatcactcagcctctggacagcgatcactcagcctctggacagcgatcactcagcctctggacagcgatcactcagcctctggacagcgataactcagcctctgtccccgtctgagatgttggcagggactgtcagatttgccaggcattgtttgaagttcttcccagccagaaacctgcatgtgtagattttggtgcttccagaggcagggctatgctcacattcatggcctctgacagcgaggaagaagtgtgtgatgagcggacgtccctaatgtcggccgagagccccacgccgcgctcctgccaggagggcaggcagggcccagaggatggagagaatactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttag

SEQ ID NO: 445329 - DNA, 2534 bp, Homo sapiens
ggcgtggggcggggcctgggccggcgccgggtccggccgggcgctcagccagctgcgtaaactccgctggagcgcggcggcggagcaggtgagcgggcggtgccggggggtgcccaggccagggccctgtcgcctgcggcgctgagggcccggggtggggctgcgccctgagggccctgccctgccctccgcacgcctctggccacggtcccttccccggctgtgggtctgcggcccctgcgtgcgcagcgctcctggcctctgcggccagcgcgggggcggagagaggagagtgcccggcaggcggcggctgggccggcccggaactgggtcgtggaaggatcgcggggagcggccctcaggccttcggcctcactgcgtccccacttccctgcgcccgcctgccgccgagccccggctgggggtgggcgcggcgcgagcggttaaagggccggtgcatttaaaggagcggtgcacgtgggtctctgaggcgtgtagcaggcgggggcgttttgttcttcttctctctcgccggagacctccgttgcgccgagtccattcggcctctagcaccgggtcctgggcatgctttccccgggaaggaggcgcgcgggggctctgcccgcacgtgaggggcagggccgcaggctcaagcctagagccggtttctgttagcagcggtgtttggctgttttatcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtgttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttggagtttggtccgttgtaaatgttgacccctctccctgcatcttgggcacccctgggataacttgtgctgtgagcccaggatggaggcagtttgccctgtttgaaggaacttttaatgatctcgcctctctgc

SEQ ID NO: 445330 - DNA, 1947 bp, Homo sapiens
ggcgtggggcggggcctgggccggcgccgggtccggccgggcgctcagccagctgcgtaaactccgctggagcgcggcggcggagcaggtgagcgggcggtgccggggggtgcccaggccagggccctgtcgcctgcggcgctgagggcccggggtggggctgcgccctgagggccctgccctgccctccgcacgcctctggccacggtcccttccccggctgtgggtctgcggcccctgcgtgcgcagcgctcctggcctctgcggccagcgcgggggcggagagaggagagtgcccggcaggcggcggctgggccggcccggaactgggtcgtggaaggatcgcggggagcggccctcaggccttcggcctcactgcgtccccacttccctgcgcccgcctgccgccgagccccggctgggggtgggcgcggcgcgagcggttaaagggccggtgcatttaaaggagcggtgcacgtgggtctctgaggcgtgtagcaggcgggggcgttttgttcttcttctctctcgccggagacctccgttgcgccgagtccattcggcctctagcaccgggtcctgggcatgctttccccgggaaggaggcgcgcgggggctctgcccgcacgtgaggggcagggccgcaggctcaagcctagagccggtttctgttagcagcggtgtttggctgttttatcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggccgagagccccacgccgcgggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttggagtttggtccgttgtaaatgttgacccctctccctgcatcttgggcacccctgggataacttgtgctgtgagcccaggatggaggcagtttgccctgtttgaaggaacttttaatgatctcgcctctctgc

SEQ ID NO: 445331 - DNA, 383 bp, Homo sapiens
tccctgtattaggaaggggaaagatcttttgattcattaaccattaagttgattcattaaccattaagtcttgggcctgcagaccatagcaaccttccttccttcatttatggtgcttcatccagctccaaatcttctctactttgtcctcacaaacttttcatatgccctagtagctcatagactgctccttatatctggaaagcaacattcaaacttctcatttctggttccaaaaatccgtgcattacatggataggctgccatgggggacattccgcggccctcacgatgtggtttcccacagagaagccaggagaacgaggaggacggtgaggaggaccctgaccgctatgtctgtagtggggttcccgggcggccgc

SEQ ID NO: 445332 - DNA, 2301 bp, Homo sapiens
ggcgtggggcggggcctgggccggcgccgggtccggccgggcgctcagccagctgcgtaaactccgctggagcgcggcggcggagcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggccgagagccccacgccgcgctcctgccaggagggcaggcagggcccagaggatggagagaatactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttag

SEQ ID NO: 445333 - DNA, 2027 bp, Homo sapiens
ggcgtggggcggggcctgggccggcgccgggtccggccgggcgctcagccagctgcgtaaactccgctggagcgcggcggcggagcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggccgagagccccacgccgcgctcctgccaggagggcaggcagggcccagaggatggagagaatactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttag

SEQ ID NO: 445334 - DNA, 986 bp, Homo sapiens
tgcccttaacacctcaagagctgttgcaggaccagggaagataatggggtgtctagcgccgttatccgactggtcctcgaacaagctcctgtgcccagggactagaccatgactcacagctcctgtccacaccagggatcaccacgctcaccctcccctccatgtcctgcagggggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttggagtttggtccgttgtaaatgttgacccctctccctgcatcttgggcacccctgggataacttgtgctgtgagcccaggatggaggcagtttgccctgtttgaaggaacttttaatgatctcgcctctctgc

SEQ ID NO: 445335 - DNA, 4830 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaa

SEQ ID NO: 445336 - DNA, 4458 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattaca

SEQ ID NO: 445337 - DNA, 5109 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaaaaaaaaaaaaaaaaagaaaaaaaaacagttttgtagggggatgaggacacagaaagggtttacgagacacatgggtatgagcggaggggcaccggagagtaaggtagacagtggaaaaaggggaacacaaagaaaacccgggacaaaaaaagtggcgtgagatccgcagccaaaaaaagggccgggggaaccggaggatgtagacaaaccacaaggaacacgaggacaccaggggactaccaaagagaaccaagaactcagaataagaaccgcagcatg

SEQ ID NO: 445338 - DNA, 4776 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaa

SEQ ID NO: 445339 - DNA, 4640 bp, Homo sapiens
  misc_feature (38)..(39): n is a, c, g, or t
  misc_feature (4599)..(4599): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttacntacaacagaaaaggtaaatcttcgtcgacgcggccgcgaat

SEQ ID NO: 445340 - DNA, 2037 bp, Homo sapiens
agttgatttagtaagaaattggtcatgattttaagggtgaatcttgttgtgtctctccctggctacagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaa

SEQ ID NO: 445341 - DNA, 3002 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatgtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcaggtatgatgtatcaggcatagagtccacaagcctagttctgactctctgggtttctctttctatctgagactatgtatcactcacctctattttaattggtcttttccaaactcttttgtcatatcagcctaatccattgtgtccaaataagcatgtttaagcttatgcttagataagaaagtaga

SEQ ID NO: 445342 - DNA, 2731 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaaggtaagtgtaggcagagtatctgaaagtacttttattaaaatgaaagtacttttataaaaaacaaatcaggcatttgttgattggtattccttacatttgatagatttaatttagacttggcattacacatatcctgagtttacttaggactgggaacaatcttagtattgacatttcaaaactttatccagtcaagagaccacctttgaagctgacctcttcaagatttgtctttaagaacaccaatataatttcagtactttgggaggccaaggcaagaagattgcttggggtctggagtttaagaccagcctgggcaacacagtgagatgctatctcta

SEQ ID NO: 445343 - DNA, 254 bp, Homo sapiens
cacaattttctcaagttttgtattcagtacagttgtcattcacttcttagacaaagaattgacaggcttgaagtaagtatttaaaacctaaatatactttctgtcaaaatacattttaaaaaacttttcttccccatgctgtaaaggtacattttcaaaagttaagaaaataaggggaaatttttttgtataattttactattagctaattttaataactattaacattttggcatatatccttttctactgtt

SEQ ID NO: 445344 - DNA, 747 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtaatagttttacatatttaacttctggtgtcatcagatttttgatttgctgtggaaataaacctg

SEQ ID NO: 445345 - DNA, 4441 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattaca

SEQ ID NO: 445346 - DNA, 4980 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtgtaagttggcatttatatatttgccagtttaaaaatacatcataagtaaggcaatgagaagagttttaaggacaattagtgataccttttgggtcaagcatgagcatttttgggtaacatgtgcttgcttctctaacatatactgtgtagcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaa

SEQ ID NO: 445347 - DNA, 3889 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgttaattttaaaaagtcgacgcggccgcaatttattagtaatgtcgacccggaattcggaccgtacctgccggcgtccagctttcctatgtgagtcttttaaagctggcgtaatc

SEQ ID NO: 445348 - DNA, 2666 bp, Homo sapiens
  misc_feature (38)..(39): n is a, c, g, or t
gcctggtcccctatcgcctccgcctagcagctgccatnngtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtgtaagttggcatttatatatttgccagtttaaaaatacatcataagtaaggcaatgagaagagttttaaggacaattagtgataccttttgggtcaagcatgagcatttttgggtaacatgtgcttgcttctctaacatatactgtgtagcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcaggtgtgtgagtggatttgtatgtacagttatatctatttgtttattttagaaccagtgtcattttctgtgattaccaaacataattgttaacatattacctgctaaagagcacataacagaatatcaactttaaagccattcatttaaaatgagtaatatttatgcttggttggggggaaaaaaagaatgttgattcaaatgaatagctccacagaggtaaattagtaagaaa

SEQ ID NO: 445349 - DNA, 1287 bp, Homo sapiens
cgctccagtgacgtcacggcgccactttccggccggtgacagagtccagcggagttgtgggggccggaggcgccatgggagccactggcgacgccgagcagccgcggggacccagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacaca

SEQ ID NO: 445350 - DNA, 1355 bp, Homo sapiens
cgctccagtgacgtcacggcgccactttccggccggtgacagagtccagcggagttgtgggggccggaggcgccatgggagccactggcgacgccgagcagccgcggggacccagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacaaaaaaaactttagagcacaatggatctcgagcaaggagaggacagcgattctcgtacgaacggttacc

SEQ ID NO: 445351 - DNA, 1456 bp, Homo sapiens
gaaggtacagacatatcccgtatactccctgaccctacacatgcacagcctcccccattatcgacatcaggcaccagagtggtacatttgttacatttgatgagcctactttgactcgtcttgatcctcagagtgcatagtttccatgagggttcactcttggtattgtacatgaacttagacaaatgcatagtgacaggcatccaccattctagtatcacactgagtgctttcagtgccctaaaaatcctctgtgttctgcctgttcatccttccttccccctcaaccaacccccaaccccactttttaaaaaaaattctgaagcagcagaatctttttcaaacaaaactttacatgggagcccagtatttaaatcaaataaagccacactggtctggttcaggggcgtggggttagtttggaacagctggcttagtagatgggctagtattaactgtcataccttagatgtgtctcctacacgaagcagttttattcctcacaaacacaagataggtagggcagttgctgtttttgtctcttttgacagatgagaaaactgccactcagaggttcttggagttgctcatgccactatgtaagagcagagctagtgctagaatggcttctagtccagtgctttttttccctttgttcctcctcttatgtgtcaccacgaaggaggatgtccagggctaaagtgagagtgtgtgaggaactcctaccaccaccagcaagctggcatttagtcctaggtctcaccttggagaattcacctttattctttccttccaagcagatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacaca

SEQ ID NO: 445352 - DNA, 819 bp, Homo sapiens
cgctccagtgacgtcacggcgccactttccggccggtgacagagtccagcggagttgtgggggccggaggcgccatgggagccactggcgacgccgagcagccgcggggacccagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaaggtaggtgactgctgggaggaaa

SEQ ID NO: 445353 - DNA, 361 bp, Homo sapiens
ggaggaggtggacgcagagcagctgatccaggaagcctgtcggagctgcctggagcaggtgagaccaaaggggacaagagatgcaggcacaaggtttagctctcgagcctctgataagaaatgcgatcttaagccggacgtggtggctcacacatgtaatcccagcactgtgggaggccaaggtgggcagatcactcaaggccaggagtttgagaccagcttgggcaacgtggctaaaccccatctctacaaacaatacgaaaattagctgggcatggtggtgcacgcctataatcctagctgcttgggagccataggcacgagaatcgcttgaacctgggagacagaggttgcggtgagc

SEQ ID NO: 445354 - DNA, 960 bp, Homo sapiens
cgctccagtgacgtcacggcgccactttccggccggtgacagagtccagcggagttgtgggggccggaggcgccatgggagccactggcgacgccgagcagccgcggggacccagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggtgcgtggtggatcaagttatcatggccccatttggtatcatggggatgagcaccctgctgcctccctgcctctctggtgtggtcaggaagcatgacatcaggtctataaatgactgttcccaagatagtagagaacctgtttacatgtgtcagctgctgttattaggaggaattgttgccatcaccattttatagggagacatcaggaaaggtcgccaatagtcgctggctcactttctcacctcctattcattctcttcactttgttttcgcttcagtccccactacttcactggaacccctcttgtcggggtcgctagtaacttccgtgttgtcaaaccctctggtccctaactgtcctcaacttactcagcttctcagtgacatctgtcacaatggatcatttcgcgtttcttggaatgctcctctgttggctagagtgccttgactttgctccaacctcattgcctactcttctctctcaccccccgcctctaactgttggtgccttcc

SEQ ID NO: 445355 - DNA, 1303 bp, Homo sapiens
cgctccagtgacgtcacggcgccactttccggccggtgacagagtccagcggagttgtgggggccggaggcgccatgggagccactggcgacgccgagcagccgcggggacccagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacaggtaaaaccagtgggtctcctgccccttctcctctccctgcctccaaatagcccctagaatgaggcagggcctacatcctcacttcccccaacttctctcttcaatgtctgttccagaggatgcctggatctgaagctagaggaattgaaatcctttgtcctaccctcctggatggtggagaagatgagaaagtatatggagacactacggacagagaatgagcatcgtgctgttgaagcacctccacagacctgagcaagccaggcctggcttgctcaggcctcccctggtcggggtgctccacagaagctgtgcctgggcttgggagccaaggacatgtccctctcccggccaggggagacggagcccatccacagt

SEQ ID NO: 445356 - DNA, 599 bp, Homo sapiens
cgctccagtgacgtcacggcgccactttccggccggtgacagagtccagcggagttgtgggggccggaggcgccatgggagccactggcgacgccgagcagccgcggggacccagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaaggtgagagggacacaggataaaaaataacaggagaaagactcatgaggagcccagtccttgcctgcatcaccagtctgtctctttcctacatacagatatctaaagttttcctttcttgttgtttttgttttgttttgttttgtgtttttgagacagattctgtctcaaaaacaaacaaaaaaagaaatgtgatcttgtcatcagtggtattttggggaatgcccagcaagccacatattgagataggcttga

SEQ ID NO: 445357 - DNA, 3114 bp, Homo sapiens
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgccgtcagggcctttgcgaaggttgttccttgtaactggaatgcccttccatccctttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaaggcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgactgagtctccaaatcccttcaccctgtttggttctgcaacggggattaggggagccccacgatttgttttcaaaggatgtccgggctccaggacaggatgccctgggtcacctgatgacaggtgtggtggttggaaagggccgggtttcagctccgggtacacttcctccttccttctgctgcgtggtgtggcctcttccacgtcctcagaatccagctgttactcgtccgcggcctctcagctctagggccctctgcacactggcccccccagtgtcacgggcatccagacgggatccagtgcatcctcttttagaagaaaggcctgtctccaggtccccgagtccctctagcatctcccagaaggtgtcaagacgcagcagtgtccagggagcggcagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggaggcactgggccctgggaactggcacccatgggcccacccatgagtgatggttctggctgatttgtttgtgatgttgttagccgcctgtgaggggtgcagagagataatcaccgcaccgtttccagatgtaatactgcaaagaaaaccaatgatgaggccgggtgcggtggctcacacctgtaatcccagcactttgggaggccgaggcaggcggatcacaaggtcaggagatcgagaccatcctggccaatatggtgaaacccgtctctattaaaaatacaaaaattagtggggcgtggtctcaggctcctgcagtcccagctacttgggaggctgaggcaggagaatggtgtgaaccagagagtcggaggttgcagtaagccaagatcgcgccattgcactccaacctggacgacagagcaagactccatctcaaaaaaataaaataaa

SEQ ID NO: 445358 - DNA, 2985 bp, Homo sapiens
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgccgtcagggcctttgcgaaggttgttccttgtaactggaatgcccttccatccctttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaaggcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgactgagtctccaaatcccttcaccctgtttggttctgcaacggggattaggggagccccacgatttgttttcaaaggatgtccgggctccaggacaggatgccctgggtcacctgatgacaggtgtggtggttggaaagggccgggtttcagctccgggtacacttcctccttccttctgctgcgtggtgtggcctcttccacgtcctcagaatccagctgttactcgtccgcggcctctcagctctagggccctctgcacactggcccccccagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggaggcactgggccctgggaactggcacccatgggcccacccatgagtgatggttctggctgatttgtttgtgatgttgttagccgcctgtgaggggtgcagagagataatcaccgcaccgtttccagatgtaatactgcaaagaaaaccaatgatgaggccgggtgcggtggctcacacctgtaatcccagcactttgggaggccgaggcaggcggatcacaaggtcaggagatcgagaccatcctggccaatatggtgaaacccgtctctattaaaaatacaaaaattagtggggcgtggtctcaggctcctgcagtcccagctacttgggaggctgaggcaggagaatggtgtgaaccagagagtcggaggttgcagtaagccaagatcgcgccattgcactccaacctggacgacagagcaagactccatctcaaaaaaataaaataaa

SEQ ID NO: 445359 - DNA, 3159 bp, Homo sapiens
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgccgtcagggcctttgcgaaggttgttccttgtaactggaatgcccttccatccctttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaaggcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgactgagtctccaaatcccttcaccctgtttggttctgcaacggggattaggggagccccacgatttgttttcaaaggatgtccgggctccaggacaggatgccctgggtcacctgatgacaggtgtggtggttggaaagggccgggtttcagctccgggtacacttcctccttccttctgctgcgtggtgtggcctcttccacgtcctcagaatccagctgttactcgtccgcggcctctcagctctagggccctctgcacactggcccccccagtgtcacgggcatccagacgggatccagtgcatcctcttttagaagaaaggcctgtctccaggtccccgagtccctctagcatctcccagaaggtgtcaagacgcagcagtgtccagggagcggcagcagattgaggaagagtctggggacacaccagaaaaggacaggatcaagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggaggcactgggccctgggaactggcacccatgggcccacccatgagtgatggttctggctgatttgtttgtgatgttgttagccgcctgtgaggggtgcagagagataatcaccgcaccgtttccagatgtaatactgcaaagaaaaccaatgatgaggccgggtgcggtggctcacacctgtaatcccagcactttgggaggccgaggcaggcggatcacaaggtcaggagatcgagaccatcctggccaatatggtgaaacccgtctctattaaaaatacaaaaattagtggggcgtggtctcaggctcctgcagtcccagctacttgggaggctgaggcaggagaatggtgtgaaccagagagtcggaggttgcagtaagccaagatcgcgccattgcactccaacctggacgacagagcaagactccatctcaaaaaaataaaataaa

SEQ ID NO: 445360 - DNA, 2709 bp, Homo sapiens
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgccgtcagggcctttgcgaaggttgttccttgtaactggaatgcccttccatccctttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaaggcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgactgagtctccaaatcccttcaccctgtttggttctgcaacggggattaggggagccccacgatttgttttcaaaggatgtccgggctccaggacaggatgccctgggtcacctgatgacaggtgtggtggttggaaagggccgggtttcagctccgggtacacttcctccttccttctgctgcgtggtgtggcctcttccacgtcctcagaatccagctgttactcgtccgcggcctctcagctctagggccctctgcacactggcccccccagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggaggcactgggccctgggaactggcacccatgggcccacccatgagtgatggttctggctgatttgtttgtgatgttgttagccgcctgtgaggggtgcagagagataatcaccgcaccgtttccagatgtaatactgcaaagaaaaccaatgatgaggccgggtgcggtggctcacacctgtaatcccagcactttgggaggccgaggcaggcggatcacaaggtcaggagatcgagaccatcctggccaatatggtgaaacccgtctctattaaaaatacaaaaattagtggggcgtggtctcaggctcctgcagtcccagctacttgggaggctgaggcaggagaatggtgtgaaccagagagtcggaggttgcagtaagccaagatcgcgccattgcactccaacctggacgacagagcaagactccatctcaaaaaaataaaataaa

SEQ ID NO: 445361 - DNA, 1186 bp, Homo sapiens
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgccgtcagggcctttgcgaaggttgttccttgtaactggaatgcccttccatccctttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaaggcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgactgagtctccaaatcccttcaccctgtttggttctgcaacggggattaggggagccccacgatttgttttcaaaggatgtccgggctccaggacaggatgccctgggtcacctgatgacaggtgtggtggttggaaagggccgggtttcagctccgggtacacttcctccttccttctgctgcgtggtgtggcctcttccacgtcctcagaatccagctgttactcgtccgcggcctctcagctctagggccctctgcacactggcccccccagtgtcacgggcatccagacgggatccagtgcatcctcttttagaagaaaggcctgtctccaggtccccgagtccctctagcatctcccagaaggtgtcaagacgcagcagtgtccagggagcggcagcagtgcactccaacctgggcgacacagtgagactgtctcaaga

SEQ ID NO: 445362 - DNA, 2594 bp, Homo sapiens
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtgccttttcactttgtactcaaagccacatcgcattgaagccacaggtggggcaaggtcatgcatgactgagtctccaaatcccttcaccctgtttggttctgcaacggggattaggggagccccacgatttgttttcaaaggatgtccgggctccaggacaggatgccctgggtcacctgatgacaggtgtggtggttggaaagggccgggtttcagctccgggtacacttcctccttccttctgctgcgtggtgtggcctcttccacgtcctcagaatccagctgttactcgtccgcggcctctcagctctagggccctctgcacactggcccccccagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggaggcactgggccctgggaactggcacccatgggcccacccatgagtgatggttctggctgatttgtttgtgatgttgttagccgcctgtgaggggtgcagagagataatcaccgcaccgtttccagatgtaatactgcaaagaaaaccaatgatgaggccgggtgcggtggctcacacctgtaatcccagcactttgggaggccgaggcaggcggatcacaaggtcaggagatcgagaccatcctggccaatatggtgaaacccgtctctattaaaaatacaaaaattagtggggcgtggtctcaggctcctgcagtcccagctacttgggaggctgaggcaggagaatggtgtgaaccagagagtcggaggttgcagtaagccaagatcgcgccattgcactccaacctggacgacagagcaagactccatctcaaaaaaataaaataaa

SEQ ID NO: 445363 - DNA, 2890 bp, Homo sapiens
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgccgtcagggcctttgcgaaggttgttccttgtaactggaatgcccttccatccctttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaaggcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgactgagtctccaaatcccttcaccctgtttggttctgcaacggggattaggggagccccacgatttgttttcaaaggatgtccgggctccaggacaggatgccctgggtcacctgatgacaggtgtggtggttggaaagggccgggtttcagctccgggtacacttcctccttccttctgctgcgtggtgtggcctcttccacgtcctcagaatccagctgttactcgtccgcggcctctcagctctagggccctctgcacactggcccccccagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggaggcactgggccctgggaactggcacccatgggcccacccatgagtgatggttctggctgatttgtttgtgatgttgttagccgcctgtgaggggtgcagagagataatcaccgcaccgtttccagatgtaatactgcaaagaaaaccaatgatgaggccgggtgcggtggctcacacctgtaatcccagcactttgggaggccgaggcaggcggatcacaaggtcaggagatcgagaccatcctggccaatatggtgaaacccgtctctattaaaaatacaaaaattagtggggcgtggtctcaggctcctgcagtcccagctacttgggaggctgaggcaggagaatggtgtgaaccagagagtcggaggttgcagtaagccaagatcgcgccattgcactccaacctggacgacagagcaagactccatctcaaaaaaataaaataaa

SEQ ID NO: 445364 - DNA, 2519 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgtta

SEQ ID NO: 445365 - DNA, 1893 bp, Homo sapiens
gcagattccaagaacctttcaacaacgctaagtgaggacctgctatacgtacagacatacacacattttctctctctctctgaatctggccctttgtttttctctgttacagatagcttgcctcagttggtagcttgtcttttctctctcctcatgatgtccataattttgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgtta

SEQ ID NO: 445366 - DNA, 3022 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgttatctgatgtattttttactttaagaaatcatgagaaattccttttactgaggtattttcaaagcatatttacagggagataatctgttcaacaggaattactctctaacaccttgaaaaagttaaaggaaaccaagcctgtgatttttaagataagtacaagttccagtcttaaagctggagaaagagcagtactaaagatttataataaattgtctataataaattgtttttcttacaaaagaaatgtttaagaatgtttgcttagaggaaataatgaactaagcccatctatcagaggaatgccttcagacaattaaaatgatggcaacagagatttctttttacacctaaaagcgagcatccccgttttgcacgttagcattgggaaaaggacagcttattactgaagtactttaggagtggcagtttcaacaacccagctttaggttctaggacctacaggacctactgattctctggcataataaaacactgaactcag

SEQ ID NO: 445367 - DNA, 2598 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcaggtaatataaatttttgtaaattttataaatggctgccaggaaaatgagcagactaacatttttttttttcctttttcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgtta

SEQ ID NO: 445368 - DNA, 665 bp, Homo sapiens
tttttcattaatacaggcttctgatgaaaaatgcaatttgttctttagtgcttaaaaaaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgtta

SEQ ID NO: 445369 - DNA, 1462 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattgaccaggacagagaaatactcagtgatctggcttgactgcattaatttcagcaacatttctatagcgactaaagggttgttttccacaaggtcaggaagtttggctggggtgaggccaatatggtagacaagtttggggcctcggcggtttggacgttcggcgtgtgcaggtccatacacaagacgcaccaaccgattctgcatatatttatcctgaatttattcacctttattatcaaattgctctctactgtgaacagattaggataatattgcagaatcgtcgggtctcggggtgc

SEQ ID NO: 445370 - DNA, 1312 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgactggtaaatgtttgttaatgagtcgctagtacatatatctgagcaaaaccagaaattcgcatttctggaaaaaaattccattccaatactgctaactcaacccagaaggttatcaaatctctttttcattcctttctcttcaaccagaaagaaaatactatctggacactttcagacatttcttccccagcaaaccaaagcaagcaaatcaaggcttaaactttgtcgtctacattacttccttaacttgttcaaactgaaattgctgtcttttcacgctgtgcaacttcagaaaaggtaaaaaataaagaacagaagaatgcaataagatatgtactgacagcactacgtaatacctgctccaaagagggtttttacaccagtcaaaaattctaacagtttaaacaactgctcaacttggcacagcacagccctagatgatgccttcgcttcttccctaaatcctcagtctcaagccattcatacgtgtaaaaccatgtacaagagacaaaaacgtgtagcggatgaccatgttactctagatacagc

SEQ ID NO: 445371 - DNA, 1742 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagc

SEQ ID NO: 445372 - DNA, 3083 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgttaaaaaaaaaaaaaaaaaaaaaaaaaaaacacaaaaaacaaaaaaaaaaaaccaaaaaaaaaaaaaaacacaaaaaaaaaacgcaaaaaaaaacaagaaaacaaccacaccacaaagaaaaataaaaaaaacatcacacacaaccacaacgaggggggcggcgcggcccgccacctacgccagaccgcgacgagcgacacggcggcgccaacgcgcgatacgcaaccaccaaaggcagcgatcccgaccacagtaggagccgaagcaagaacacgcagaacacgggacagcacgtcgcccccacgacacaactgacggcggtcgggcgagcgagccaagccgagacgaccgtggatgcgaactagccggccaccatgcgccattccccctcggccgtgcccggacggccggtcccggcggccgggcagaaaagcagcgagtcatgggagcaggtcgtccgtgcttcgccacgctcccccatcaccggtgcggaaggcgtctgacacacatggtcgtcgacgaccccccgcctgcgccctctcgcctcgtcgcggcccgtccgcgcg

SEQ ID NO: 445373 - DNA, 2465 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgtta

SEQ ID NO: 445374 - DNA, 2555 bp, Homo sapiens
agcgggcgctttacggccgcggggacggagcgagccggcgccaggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggccctgggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggaaaagaccagcagcttctcgtatcctactgaattcaatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgtta

SEQ ID NO: 445375 - DNA, 425 bp, Homo sapiens
attaagagatttctttgcatactttattaagtgaaatgtgtgagatgtgtagagatgttagcttcctgataggagcaactatcacggctctcattacaggccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacaggtgtgtattgattgtaagcattttcttatctttttttttaaatttatttttaattaaaaaaatttgtttttgagacagagtctcactcggctgcccagggtggagtgcagtggcacgatctcg

SEQ ID NO: 445376 - DNA, 779 bp, Homo sapiens
ctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaagcggcctcgcaggtccgcggccccacggtggggcgacgtgccctgtccaggcctcacctcacgcgactccaaaacgcggcggagaatgcggccgtgggacccctccaggggcccc

SEQ ID NO: 445377 - DNA, 3218 bp, Homo sapiens
gctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttc

SEQ ID NO: 445378 - DNA, 4621 bp, Homo sapiens
  misc_feature (4343)..(4343): n is a, c, g, or t
  misc_feature (4477)..(4477): n is a, c, g, or t
  misc_feature (4582)..(4584): n is a, c, g, or t
  misc_feature (4586)..(4586): n is a, c, g, or t
  misc_feature (4589)..(4589): n is a, c, g, or t
  misc_feature (4593)..(4593): n is a, c, g, or t
  misc_feature (4600)..(4600): n is a, c, g, or t
  misc_feature (4602)..(4602): n is a, c, g, or t
  misc_feature (4611)..(4611): n is a, c, g, or t
  misc_feature (4619)..(4619): n is a, c, g, or t
ctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaagaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctntggggacaatgacgctgtggacagtgaggacgctgtgggggcggtgaggacactgtggagtgaggacactgggggcagtgaggacgctgtggacagtggggcgctgtgggggcggtgaggacgctgtaggggcngtgaggacgctgtggacggtgagaacgctgtggggacactgaggatgctgtgaggacgctgtgggggcagtgaggacgctgtggaccgtgaggacgctgtggggnnngngangacnctgtggncngtgaggacnctgtggangg

SEQ ID NO: 445379 - DNA, 4122 bp, Homo sapiens
  misc_feature (3844)..(3844): n is a, c, g, or t
  misc_feature (3978)..(3978): n is a, c, g, or t
  misc_feature (4083)..(4085): n is a, c, g, or t
  misc_feature (4087)..(4087): n is a, c, g, or t
  misc_feature (4090)..(4090): n is a, c, g, or t
  misc_feature (4094)..(4094): n is a, c, g, or t
  misc_feature (4101)..(4101): n is a, c, g, or t
  misc_feature (4103)..(4103): n is a, c, g, or t
  misc_feature (4112)..(4112): n is a, c, g, or t
  misc_feature (4120)..(4120): n is a, c, g, or t
atctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctntggggacaatgacgctgtggacagtgaggacgctgtgggggcggtgaggacactgtggagtgaggacactgggggcagtgaggacgctgtggacagtggggcgctgtgggggcggtgaggacgctgtaggggcngtgaggacgctgtggacggtgagaacgctgtggggacactgaggatgctgtgaggacgctgtgggggcagtgaggacgctgtggaccgtgaggacgctgtggggnnngngangacnctgtggncngtgaggacnctgtggangg

SEQ ID NO: 445380 - DNA, 3843 bp, Homo sapiens
  misc_feature (3565)..(3565): n is a, c, g, or t
  misc_feature (3699)..(3699): n is a, c, g, or t
  misc_feature (3804)..(3806): n is a, c, g, or t
  misc_feature (3808)..(3808): n is a, c, g, or t
  misc_feature (3811)..(3811): n is a, c, g, or t
  misc_feature (3815)..(3815): n is a, c, g, or t
  misc_feature (3822)..(3822): n is a, c, g, or t
  misc_feature (3824)..(3824): n is a, c, g, or t
  misc_feature (3833)..(3833): n is a, c, g, or t
  misc_feature (3841)..(3841): n is a, c, g, or t
catggtcacagctgtctgtctggtcgcactggtgtggaggagacggggtaccgacgctgcggatgcggtagtgcattgatcatagactggttaccgattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctntggggacaatgacgctgtggacagtgaggacgctgtgggggcggtgaggacactgtggagtgaggacactgggggcagtgaggacgctgtggacagtggggcgctgtgggggcggtgaggacgctgtaggggcngtgaggacgctgtggacggtgagaacgctgtggggacactgaggatgctgtgaggacgctgtgggggcagtgaggacgctgtggaccgtgaggacgctgtggggnnngngangacnctgtggncngtgaggacnctgtggangg

SEQ ID NO: 445381 - DNA, 3357 bp, Homo sapiens
  misc_feature (3079)..(3079): n is a, c, g, or t
  misc_feature (3213)..(3213): n is a, c, g, or t
  misc_feature (3318)..(3320): n is a, c, g, or t
  misc_feature (3322)..(3322): n is a, c, g, or t
  misc_feature (3325)..(3325): n is a, c, g, or t
  misc_feature (3329)..(3329): n is a, c, g, or t
  misc_feature (3336)..(3336): n is a, c, g, or t
  misc_feature (3338)..(3338): n is a, c, g, or t
  misc_feature (3347)..(3347): n is a, c, g, or t
  misc_feature (3355)..(3355): n is a, c, g, or t
gagaaaaagaacaaaaccaaccccagcagccctaagaaatctgcgccccctgagcccccactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctntggggacaatgacgctgtggacagtgaggacgctgtgggggcggtgaggacactgtggagtgaggacactgggggcagtgaggacgctgtggacagtggggcgctgtgggggcggtgaggacgctgtaggggcngtgaggacgctgtggacggtgagaacgctgtggggacactgaggatgctgtgaggacgctgtgggggcagtgaggacgctgtggaccgtgaggacgctgtggggnnngngangacnctgtggncngtgaggacnctgtggangg

SEQ ID NO: 445382 - DNA, 3037 bp, Homo sapiens
gctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggactgtcgaggcgggccgagtcttcccttatccccagacgcctagcgggcagggttgggctgaatcaaatgggagccctccagacataaggaggccagaggctgcaaggagcggggtcgtgaccgcttacaccccttctccacaggagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttc

SEQ ID NO: 445383 - DNA, 1317 bp, Homo sapiens
gctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccctgctgcgtctcccttccaaactctggtgctgaataaacccttctgatctggtcttc

SEQ ID NO: 445384 - DNA, 1195 bp, Homo sapiens
gctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagt

SEQ ID NO: 445385 - DNA, 3494 bp, Homo sapiens
ctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccggaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttc

SEQ ID NO: 445386 - DNA, 4098 bp, Homo sapiens
  misc_feature (3820)..(3820): n is a, c, g, or t
  misc_feature (3954)..(3954): n is a, c, g, or t
  misc_feature (4059)..(4061): n is a, c, g, or t
  misc_feature (4063)..(4063): n is a, c, g, or t
  misc_feature (4066)..(4066): n is a, c, g, or t
  misc_feature (4070)..(4070): n is a, c, g, or t
  misc_feature (4077)..(4077): n is a, c, g, or t
  misc_feature (4079)..(4079): n is a, c, g, or t
  misc_feature (4088)..(4088): n is a, c, g, or t
  misc_feature (4096)..(4096): n is a, c, g, or t
gctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctntggggacaatgacgctgtggacagtgaggacgctgtgggggcggtgaggacactgtggagtgaggacactgggggcagtgaggacgctgtggacagtggggcgctgtgggggcggtgaggacgctgtaggggcngtgaggacgctgtggacggtgagaacgctgtggggacactgaggatgctgtgaggacgctgtgggggcagtgaggacgctgtggaccgtgaggacgctgtggggnnngngangacnctgtggncngtgaggacnctgtggangg

SEQ ID NO: 445387 - DNA, 2996 bp, Homo sapiens
gctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgcgtggcgctggtggcggcgccgagcgtggctacggactggttggtgggcccggctggggcgctggtgctattggcgggaagtggcgcctggcccgccccggggggggcggggctttcgtggcttgtggctttttgttgttgcc

SEQ ID NO: 445388 - DNA, 4127 bp, Homo sapiens
  misc_feature (3849)..(3849): n is a, c, g, or t
  misc_feature (3983)..(3983): n is a, c, g, or t
  misc_feature (4088)..(4090): n is a, c, g, or t
  misc_feature (4092)..(4092): n is a, c, g, or t
  misc_feature (4095)..(4095): n is a, c, g, or t
  misc_feature (4099)..(4099): n is a, c, g, or t
  misc_feature (4106)..(4106): n is a, c, g, or t
  misc_feature (4108)..(4108): n is a, c, g, or t
  misc_feature (4117)..(4117): n is a, c, g, or t
  misc_feature (4125)..(4125): n is a, c, g, or t
gctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggtgtgagcctttctccctccttcccccaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctntggggacaatgacgctgtggacagtgaggacgctgtgggggcggtgaggacactgtggagtgaggacactgggggcagtgaggacgctgtggacagtggggcgctgtgggggcggtgaggacgctgtaggggcngtgaggacgctgtggacggtgagaacgctgtggggacactgaggatgctgtgaggacgctgtgggggcagtgaggacgctgtggaccgtgaggacgctgtggggnnngngangacnctgtggncngtgaggacnctgtggangg

SEQ ID NO: 445389 - DNA, 4528 bp, Homo sapiens
  misc_feature (4250)..(4250): n is a, c, g, or t
  misc_feature (4384)..(4384): n is a, c, g, or t
  misc_feature (4489)..(4491): n is a, c, g, or t
  misc_feature (4493)..(4493): n is a, c, g, or t
  misc_feature (4496)..(4496): n is a, c, g, or t
  misc_feature (4500)..(4500): n is a, c, g, or t
  misc_feature (4507)..(4507): n is a, c, g, or t
  misc_feature (4509)..(4509): n is a, c, g, or t
  misc_feature (4518)..(4518): n is a, c, g, or t
  misc_feature (4526)..(4526): n is a, c, g, or t
ctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaagaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatggtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctntggggacaatgacgctgtggacagtgaggacgctgtgggggcggtgaggacactgtggagtgaggacactgggggcagtgaggacgctgtggacagtggggcgctgtgggggcggtgaggacgctgtaggggcngtgaggacgctgtggacggtgagaacgctgtggggacactgaggatgctgtgaggacgctgtgggggcagtgaggacgctgtggaccgtgaggacgctgtggggnnngngangacnctgtggncngtgaggacnctgtggangg

SEQ ID NO: 445390 - DNA, 3271 bp, Homo sapiens
  misc_feature (2993)..(2993): n is a, c, g, or t
  misc_feature (3127)..(3127): n is a, c, g, or t
  misc_feature (3232)..(3234): n is a, c, g, or t
  misc_feature (3236)..(3236): n is a, c, g, or t
  misc_feature (3239)..(3239): n is a, c, g, or t
  misc_feature (3243)..(3243): n is a, c, g, or t
  misc_feature (3250)..(3250): n is a, c, g, or t
  misc_feature (3252)..(3252): n is a, c, g, or t
  misc_feature (3261)..(3261): n is a, c, g, or t
  misc_feature (3269)..(3269): n is a, c, g, or t
ggttctcctgtacaaaacatcgtgggaatcttgtgtcgagggttgcttttacccaaagtagtggaagatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctntggggacaatgacgctgtggacagtgaggacgctgtgggggcggtgaggacactgtggagtgaggacactgggggcagtgaggacgctgtggacagtggggcgctgtgggggcggtgaggacgctgtaggggcngtgaggacgctgtggacggtgagaacgctgtggggacactgaggatgctgtgaggacgctgtgggggcagtgaggacgctgtggaccgtgaggacgctgtggggnnngngangacnctgtggncngtgaggacnctgtggangg

SEQ ID NO: 445391 - DNA, 874 bp, Homo sapiens
gccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgc

SEQ ID NO: 445392 - DNA, 1804 bp, Homo sapiens
ctggcctactggagtgggaggaccctgcctcggggacttagggaggaaggaaggacgaggccggacaccccggcgcgcacacacacctgctgtccaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggtaagcggtcgcaggcaggcaggggagaatggcttgggggggggggggcctctttcttcccatggctcatcctggactctcagaacgccagggtccaggcagggtgcggtggcgcatgcctgtaatcccagcactttgggaggccgaggcgggcagatcacttgaggtcaggagttggagaccagcctggccaacatggtgaaacccatctctactaaaaatacaaaaattagccaggtgtggtggcgtgcgcctgtaaacctcagctacccaggaggctgaggcaggagaatcgcttgaactagggaagcggaggttgcagtgagctgagattacaccactgcactccagcctgggcaacagagggagactctgtctc

SEQ ID NO: 445393 - DNA, 5730 bp, Homo sapiens
ctttctcttccccttactcgggacgtgctggtcctcatcgagggcggtgagatgactgaggaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445394 - DNA, 5307 bp, Homo sapiens
cacgagggcggccggagcgcgcaagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445395 - DNA, 2703 bp, Homo sapiens
agcgggatttattactcccctggtgacgggagggttgtttgagattcaggaggagatcagcaagttgagggtacatttcaccatcagagcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445396 - DNA, 5595 bp, Homo sapiens
ctttctcttccccttactcgggacgtgctggtcctcatcgagggcggtgagatgactgaggaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445397 - DNA, 1860 bp, Homo sapiens
ctttctcttccccttactcgggacgtgctggtcctcatcgagggcggtgagatgactgaggaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgttccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445398 - DNA, 1883 bp, Homo sapiens
ctttctcttccccttactcgggacgtgctggtcctcatcgagggcggtgagatgactgaggaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgttccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaaggatggatggatggatggatggggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445399 - DNA, 1015 bp, Homo sapiens
agacgctcgggcggcgggacccagggaaggcagcggccggagcgcgcaaggtgttgaaagacagagaagcgaagacagagacgtggaaagacagggagagagacacggagagagacgcagaaggacagagacgtggagagagacgcagagagacagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445400 - DNA, 501 bp, Homo sapiens
gcacgagctcgtgccgaattcggcacgagggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445401 - DNA, 4041 bp, Homo sapiens
ctttctcttccccttactcgggacgtgctggtcctcatcgagggcggtgagatgactgaggaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445402 - DNA, 5378 bp, Homo sapiens
agacgctcgggcggcgggacccagggaaggcagcggccggagcgcgcaagagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacggagagacacagagagacttggagagagacaaagcaagacaggacgggagaacaaggacaagctcaggtgcccctggagccccagccctgccttcatgcccagcaggtgccctacctggcccatcctcccaaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445403 - DNA, 5368 bp, Homo sapiens
cacgagggcggccggagcgcgcaagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgggtgagcctccaggcaaatggaaaacggaatttcctgcaattggtgaccatgtgttccaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445404 - DNA, 3433 bp, Homo sapiens
cacctccgctgtcctcccctccaggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445405 - DNA, 5753 bp, Homo sapiens
ctttctcttccccttactcgggacgtgctggtcctcatcgagggcggtgagatgactgaggaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaaggatggatggatggatggatggggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaaa

SEQ ID NO: 445406 - DNA, 4686 bp, Homo sapiens
  misc_feature (3604)..(3604): n is a, c, g, or t
  misc_feature (4611)..(4611): n is a, c, g, or t
ctttctcttccccttactcgggacgtgctggtcctcatcgagggcggtgagatgactgaggaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcggtgagtctcaatccggccgggtaggcacgggatgggtgggtctctgaaaggacagagatttgttgtttttgtttttgaggcagagtctcactctgtcgcccagggtggagtgcggtggcacgatctgggctcattgcaacctccgcctcccggcttcaagccattctgctgcctcagcctcctgagtagctgggatancaggtgtggtggcgcatgcctttaatctcagctattctggaggcttaggcgggagaatcacttgaacccaggaggtggaggttgcagtgagccagagatcatgacattgggcaacaagagcaaaactctgtctcaaagaaaaaaaaaaaaaaaaaaaaacaaggacgtgggatggcgagtgatggggaagctattggagtccctcagagaagagatgacatttgagtcaacacctggagaagttagggagtgaatcacatggtcttccgggcagcaggaacaagcagtgcaaaggccctgaggcaggggtgtgtctgacgtgtttaaggagcattcaggccagactcactggttcacgcctgtaatcccagcactttgggatgccatggcgggcagatcacctgaggtcaggagttcgagaccagcctggccaacatggtgaagccctgtctctactaaaaatacaaaaattagctgggtgtggtggtgggcacctgtaatcccagatactcgggaggctgaggcatgagaattgcttgaacctgggaggcagaggttgcagtgagctgagatcgcgccactgcactccagcctgggtgacagagtgagattccgcctcaaaaaaaaaaaaaaattagctgggcctggtggtgcatgcctatagtcccagctactcgggaggctaaggcaggaggattgcttgagcccagatagtcaaggctactgtgagctatgattggaccactatactccagcctggcaacagagcaagaccctgtctttaagcaaaaaaaaatctaggccgggcacggtggctcacgcctgtaatctcaacactttgggaggccaagatgggcggatcacctgaggtcaggagtttgagaccagactgaccaacatggagaaaccccatctctactaaaaacgcaaaattagccgggcgtggtggcgcctgcctgtaatcccagctactaaggaggctgaggcaggagaatcacttgaacccnggaggcagaggttgcagtgagctgagatcatgccattgcactccagcctaggcaacaagagtgaaactctgtctc

SEQ ID NO: 445407 - DNA, 4502 bp, Homo sapiens
ctttctcttccccttactcgggacgtgctggtcctcatcgagggcggtgagatgactgaggaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccaacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaatatgatgaaaccctgtctctactaaaaaatacaaaaattagtcacacgtggtgccatacacatgtagttacagctactggggaggctaaagtggaaggatcatttgagcccgggaggtcaaagctgcagtgacccagtatcgcaccactggactccagcctgggtgatacctgtctcaaaaaacaaacaaaaaaactgtgtggtactgggcccagaataaacaactgaaaagaacagaaa

SEQ ID NO: 445408 - DNA, 2170 bp, Homo sapiens
gaactaaatatctttgaccatcccgcccgcggggtctgcctacttaacctgaggcaggtgaaagagcctcacgcagggttaggaacctccgggggcgtggcgtagcgtaacgcagtgttggggaaacttgcggctgtggattgggggaccggaaagggaggggtgggccgcaggcgccggacgtgacgtaagccggaagcgactttccgccgagaaatagggggcgcgtgtttggaaattgatagaaaagataaagggaccgagctgctgtcagcctggcttactgatctgcgtccgtttcaccacggattcagttactaagcatttttttctttttttggttctttgcaacgtgagtggcattggctcagtgatttccatgagcatctctaccagaaaacattgcctcgatgaggtgtggtggaagcccggcagccccttctaatcggctaggcttgagaaagcgtgtacctctgcatttccgaaattaactcagcgtgatcggcaagattttcctcagcatctggtgtcaagacactcgtcactattaattcggaaagaaaaaaaaaaacaaaacaccgttttccagcatttctcttggtggagaactaaacaacaggaaaaatgtctattttccctaagatatctttgagacctgaggttgaaaactatcttaaggaaggctttatgaataaggagattgtgactgctttaggtaaacaagaagcagaaaggaagtttgaaactttgttaaagcacctgtcacatcctccatcatttacaactgtcagagtgaatacacatttagcctcagtacaacatgtgaaaaatctgttacttgatgaacttcagaagcagtttaatggattaagtgttcctattcttcaacatccagaccttcaagatgtgttacttattcctgttattggacccagaaagaatattaaaaaacaacagtgtgaagccattgttggagcccagtgtggcaatgcagttttaagaggagcccatgtctatgccccaggaattgtgtcagcatcacaatttatgaaagctggagatgttatttctgtatactctgatattaaaggaaaatgtaagaaaggagccaaagaatttgatggaacaaaagtatttcttggaaatgggatttctgaactaagccgcaaagaaatcttcagtggattacctgaactgaaaggcatgggcataagaatgacagaaccagtatatctcagcccttcatttgacagtgtactgccccgttacttatttttacaaaatttgccatctgccttagtaagtcatgtactaaatcctcaacctggagagaagattctagacttgtgtgcagcacctggagggaaaacaacacacattgcagcactaatgcatgatcaggtctgctgcggtttgctggaggtccaccccagaccctgtttgaccgggtatcaccagtggaggctgcagaacagcaaaaattgctgcctgttccttcctctggaagcttcatctgaaagggcactggcccgatgctagctggaactctcctgcatgaggtgtctgtcgacccctgttgggtggtctctcctagtcaggaggcacggagatcagggacccacttgaggcaatctgtcccttagcagagctggtacactgtgctgggagaatcccccttgtcaggatcagcttctctcttcagagcccgcaggctggaaagattaagtctgcccaagctgtgcccacagccacccctccccccaggtgctctgtccaagggaaatgagagttttatctgtaagcccctgagtgggcctgctgcctgtccttcagagatgccctgcccagtgaggaggaatctagagaagcagtctggccacaactgctttgctgtgctgcggtcaattcttcccagtccaaacctcccagtctccttagcactgtcaaggtacaacagcctcctgaagactcagtaatggcggatgcccaccaagctcggtcatcccacgttgactccagactgctgtgctggctgtgagaatttcaagccagtggttcttagcttgctgggctccgtgacagtgggacctactgagtgagaccacttggctccctggcattagccccctttccaggggagtaaacggttctgtcttactggggttccagg

SEQ ID NO: 445409 - DNA, 2088 bp, Homo sapiens
gaactaaatatctttgaccatcccgcccgcggggtctgcctacttaacctgaggcaggtgaaagagcctcacgcagggttaggaacctccgggggcgtggcgtagcgtaacgcagtgttggggaaacttgcggctgtggattgggggaccggaaagggaggggtgggccgcaggcgccggacgtgacgtaagccggaagcgactttccgccgagaaatagggggcgcgtgtttggaaattgatagaaaagataaagggaccgagctgctgtcagcctggcttactgatctgcgtccgtttcaccacggattcagttactaagcatttttttctttttttggttctttgcaacgtgagtggcattggctcagtgatttccatgagcatctctaccagaaaacattgcctcgatgaggtgtggtggaagcccggcagccccttctaatcggctaggcttgagaaagcgtgtacctctgcatttccgaaattaactcagcgtgatcggcaagattttcctcagcatctggtgtcaagacactcgtcactattaattcggaaagaaaaaaaaaaacaaaacaccgttttccagcatttctcttggtggagaactaaacaacaggaaaaatgtctattttccctaagatatctttgagacctgaggttgaaaactatcttaaggaaggctttatgaataaggagattgtgactgctttaggtaaacaagaagcagaaaggaagtttgaaactttgttaaagcacctgtcacatcctccatcatttacaactgtcagagtgaatacacatttagcctcagtacaacatgtgaaaaatctgttacttgatgaacttcagaagcagtttaatggattaagtgttcctattcttcaacatccagaccttcaagatgtgttacttattcctgttattggacccagaaagaatattaaaaaacaacagtgtgaagccattgttggagcccagtgtggcaatgcagttttaagaggagcccatgtctatgccccaggaattgtgtcagcatcacaatttatgaaagctggagatgttatttctgtatactctgatattaaaggaaaatgtaagaaaggagccaaagaatttgatggaacaaaagtatttcttggaaatgggatttctgaactaagccgcaaagaaatcttcagtggattacctgaactgaaaatttgccatctgccttagtaagtcatgtactaaatcctcaacctggagagaagattctagacttgtgtgcagcacctggagggaaaacaacacacattgcagcactaatgcatgatcaggtctgctgcggtttgctggaggtccaccccagaccctgtttgaccgggtatcaccagtggaggctgcagaacagcaaaaattgctgcctgttccttcctctggaagcttcatctgaaagggcactggcccgatgctagctggaactctcctgcatgaggtgtctgtcgacccctgttgggtggtctctcctagtcaggaggcacggagatcagggacccacttgaggcaatctgtcccttagcagagctggtacactgtgctgggagaatcccccttgtcaggatcagcttctctcttcagagcccgcaggctggaaagattaagtctgcccaagctgtgcccacagccacccctccccccaggtgctctgtccaagggaaatgagagttttatctgtaagcccctgagtgggcctgctgcctgtccttcagagatgccctgcccagtgaggaggaatctagagaagcagtctggccacaactgctttgctgtgctgcggtcaattcttcccagtccaaacctcccagtctccttagcactgtcaaggtacaacagcctcctgaagactcagtaatggcggatgcccaccaagctcggtcatcccacgttgactccagactgctgtgctggctgtgagaatttcaagccagtggttcttagcttgctgggctccgtgacagtgggacctactgagtgagaccacttggctccctggcattagccccctttccaggggagtaaacggttctgtcttactggggttccagg

SEQ ID NO: 445410 - DNA, 1983 bp, Homo sapiens
aaggcaggctggtacggcccgagtggtaagatgggggcgcgtgtttggaaattgatagaaaagataaagggaccgagctgctgtcagcctggcttactgatctgcgtccgtttcaccacggattcagttactaagcatttttttctttttttggttctttgcaacgtgagtggcattggctcagtgatttccatgagcatctctaccagaaaacattgcctcgatgaggtgtggtggaagcccggcagccccttctaatcggctaggcttgagaaagcgtgtacctctgcatttccgaaattaactcagcgtgatcggcaagattttcctcagcatctggtgtcaagacactcgtcactattaattcggaaagaaaaaaaaaaacaaaacaccgttttccagcatttctcttggtggagaactaaacaacaggaaaaatgtctattttccctaagatatctttgagacctgaggttgaaaactatcttaaggaaggctttatgaataaggagattgtgactgctttaggtaaacaagaagcagaaaggaagtttgaaactttgttaaagcacctgtcacatcctccatcatttacaactgtcagagtgaatacacatttagcctcagtacaacatgtgaaaaatctgttacttgatgaacttcagaagcagtttaatggattaagtgttcctattcttcaacatccagaccttcaagatgtgttacttattcctgttattggacccagaaagaatattaaaaaacaacagtgtgaagccattgttggagcccagtgtggcaatgcagttttaagaggagcccatgtctatgccccaggaattgtgtcagcatcacaatttatgaaagctggagatgttatttctgtatactctgatattaaaggaaaatgtaagaaaggagccaaagaatttgatggaacaaaagtatttcttggaaatgggatttctgaactaagccgcaaagaaatcttcagtggattacctgaactgaaaggcatgggcataagaatgacagaaccagtatatctcagcccttcatttgacagtgtactgccccgttacttatttttacaaaatttgccatctgccttagtaagtcatgtactaaatcctcaacctggagagaagattctagacttgtgtgcagcacctggagggaaaacaacacacattgcagcactaatgcatgatcaggtctgctgcggtttgctggaggtccaccccagaccctgtttgaccgggtatcaccagtggaggctgcagaacagcaaaaattgctgcctgttccttcctctggaagcttcatctgaaagggcactggcccgatgctagctggaactctcctgcatgaggtgtctgtcgacccctgttgggtggtctctcctagtcaggaggcacggagatcagggacccacttgaggcaatctgtcccttagcagagctggtacactgtgctgggagaatcccccttgtcaggatcagcttctctcttcagagcccgcaggctggaaagattaagtctgcccaagctgtgcccacagccacccctccccccaggtgctctgtccaagggaaatgagagttttatctgtaagcccctgagtgggcctgctgcctgtccttcagagatgccctgcccagtgaggaggaatctagagaagcagtctggccacaactgctttgctgtgctgcggtcaattcttcccagtccaaacctcccagtctccttagcactgtcaaggtacaacagcctcctgaagactcagtaatggcggatgcccaccaagctcggtcatcccacgttgactccagactgctgtgctggctgtgagaatttcaagccagtggttcttagcttgctgggctccgtgacagtgggacctactgagtgagaccacttggctccctggcattagccccctttccaggggagtaaacggttctgtcttactggggttccagg

SEQ ID NO: 445411 - DNA, 1535 bp, Homo sapiens
gaactaaatatctttgaccatcccgcccgcggggtctgcctacttaacctgaggcaggtgaaagagcctcacgcagggttaggaacctccgggggcgtggcgtagcgtaacgcagtgttggggaaacttgcggctgtggattgggggaccggaaagggaggggtgggccgcaggcgccggacgtgacgtaagccggaagcgactttccgccgagaaatagggggcgcgtgtttggaaattgatagaaaagataaagggaccgagctgctgtcagcctggcttactgatctgcgtccgtttcaccacggattcagttactaagcatttttttctttttttggttctttgcaacgtgagtggcattggctcagtgatttccatgagcatctctaccagaaaacattgcctcgatgaggtgtggtggaagcccggcagccccttctaatcggctaggcttgagaaagcgtgtacctctgcatttccgaaattaactcagcgtgatcggcaagattttcctcagcatctggtgtcaagacactcgtcactattaattcggaaagaaaaaaaaaaacaaaacaccgttttccagcatttctcttggtggagaactaaacaacaggaaaaatgtctattttccctaagatatctttgagacctgaggttgaaaactatcttaaggaaggctttatgaataaggagattgtgactgctttaggtaaacaagaagcagaaaggaagtttgaaactttgttaaagcacctgtcacatcctccatcatttacaactgtcagagtgaatacacatttagcctcagtacaacatgtgaaaaatctgttacttgatgaacttcagaagcagtttaatggattaagtgttcctattcttcaacatccagaccttcaagatgtgttacttattcctgttattggacccagaaagaatattaaaaaacaacagtgtgaagccattgttggagcccagtgtggcaatgcagttttaagaggagcccatgtctatgccccaggaattgtgtcagcatcacaatttatgaaagctggagatgttatttctgtatactctgatattaaaggaaaatgtaagaaaggagccaaagaatttgatggaacaaaagtatttcttggaaatgggatttctgaactaagccgcaaagaaatcttcagtggattacctgaactgaaaggcatgggcataagaatgacagaaccagtatatctcagcccttcatttgacagtgtactgccccgttacttatttttacaaaatttgccatctgccttagtaagtcatgtactaaatcctcaacctggagagaagattctagacttgtgtgcagcacctggagggaaaacaacacacattgcagcactaatgcatgatcaggcggttcagctgctgaagccagagggtgtgcctggtttatagcacgtgcactataacactggccgaaaatgtagaacaggttgtcctgggcctgaccaaaatttccttgtcctttcagcttcagccccaggaac

SEQ ID NO: 445412 - DNA, 606 bp, Homo sapiens
gggtatagttgggccccatgatcctgaccttcaggccagtggagaccagccccgagaagactcgtccaaaggcgtagaaccgacctttgtcggaggttggcaccattttggaaatatacatcataagagggcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445413 - DNA, 304 bp, Homo sapiens
gagagagagagagagagagagagagagagagagagagagagagagagagagagagagagagagagagggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445414 - DNA, 469 bp, Homo sapiens
ctgatgctgcggtcattctagaggatccctcgaagactggcggttggtgatcactgcaacaaggcgttccggcagacagcagctgatcctggacccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtacctcacccgtagctgtacctcacccgtagctgtacctcacccgtagctgtacctcacccgtagctgtacctcacccgtagctgtacctcacccgta

SEQ ID NO: 445415 - DNA, 1037 bp, Homo sapiens
  misc_feature (802)..(802): n is a, c, g, or t
tacgtcggtaccgtgatggctcacaggtggtggcggcaccccatgtggtggtcaggctatctgcccgtcaacgagtcctttggcttcagcgctgaccgtgaggtccaacacgggcgtgcaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggcccgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaanaagcacaaccggctgtacatgaggcgcggccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggcccaacatcctcaccgacatcaccaagggatgtactgacgatgtaccagcatgat

SEQ ID NO: 445416 - DNA, 1770 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445417 - DNA, 1781 bp, Homo sapiens
  misc_feature (1756)..(1756): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaacnacaacccccccgccaaaaggggggc

SEQ ID NO: 445418 - DNA, 2114 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaacaagccccagcaagccaaagacagtgaacggcacacaagcagcgaaccaccagggggggcggccgcgcgcaccaaaagataacccccggcgggagaggccaaccaagcaagacaggggacccaagccacgatgttttggatgcaaaaagaggacagcacccccaacatacgaggaagggtaatcataccaagcgcaacacccgcgcgccggcataagaaaaaaaaagacgcgggagcgagcggaacaccctcgacagcaggaaagactatggaggcgacaccacacactttccggggggggagacaaaccgaggcaaagacgcccccagcggaagatcaacagcggggaagcagac

SEQ ID NO: 445419 - DNA, 2429 bp, Homo sapiens
  misc_feature (1794)..(1794): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaacatcaacacaaacaaaacaaaaacacaaaaaaaanaaaaaaaaaaaaacaaaaaaaacaaaagaaaacaaagaagaaaaataaaaacaaaatctaatgaaaaaagttacacatagtacccttagaaaaccagagccatcgtacccatagaggccccacacaaccggcagagcaaggctaaggccctacagctacttgtcatccgggaccaaatagctactcttagctgcaattctttgaacacctaacgttaaactttggaaaggcactgaattaaccaaattgaatgtgttgccgacttcaggcgcccatgcggcagaggatttcacggatatgccacgccctcatgattcgtttatgctaggatccttgtgttctcacttgagtgaacctgtggcttcagttgtatcaactacactaatctttcacagctcgcttggataacccttgctatggtgtctaagttacctcgaagcaatgttgcaatcgccatttatcaatttgctggtcctccttgaaacaatctctcaaggtttctagggctattggtaaatgtgccttccactctcctcaaagtgtttttcctccattatgtcagctttaaattgctaaccgtcacaagccccagtgaacactggcaactcggtcaaaccttgcactgcttggaaccc

SEQ ID NO: 445420 - DNA, 2465 bp, Homo sapiens
  misc_feature (1766)..(1766): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaanaaaaaaaaaaaaaaaaaaaaaaaaaaaaaactttttggggcccatatgggcccctagagaaaacgctttacgaaaacacaactaggaatggggacggcgcgggcccccaagataagtgaacagtgaacccgtgggccacaacagcgggttccaaactgggggaaacaccggggcacacgacacaagagggcaggaggaaaatacaccaccacatcataaagaaagaccaccggggaggggcaccacacaaggacagaggtcatgggacagacaaacacccccaagacgggagagcatctcggggagcggccaacaaaacaggggaggctcctctcaccaacaagagggagacccaaacagccagagagacccgcgagaatatataaagaataacaagcacccaggagcaggggaggacaacacagcagcggagaagaaagacaaagaagcagccgcgcagagcacaggaggcagaggagcgggagacgcacgcgacagaccagagagcaggggcgaacgggagaaggggaagcagggagagcagaggaagagaacgagggccaacggcgagggagccaagacggcagaaagagagcgacggagggcacgcagaaagcacgcagagaagaagcacgaagcagagaggagagaaccccaaacaggaaggaagaacagagcagaaggaaacgtaggagaagg

SEQ ID NO: 445421 - DNA, 2404 bp, Homo sapiens
  misc_feature (1766)..(1766): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaanaaaaaaaaaaaaaaaaaaaaaaaaaaaaaaaaaaaaaaaaaaaacacgggggcttttttgggggggggggaacaacagcggagacagagaagtgggcgacgacggacaaaacacagaagaacagaaaggacgcaaccagaatataggataacaaaagggggagaagacatagagacgggccaccaacaaataagagcagagagaaaatcataaagagagaaagacagaggagataacacaaggaaacaaaaagagacacgacaagaagacacaagatacagaagaagagaagaagagaagaggagggaaaaaaagagagagaagaaggaggaagaaagacgagaagagagaacaagacgagaggaggagagaagaagacgagagagtcaggaaagaacgacaaaaacagcgaaaagaaagggggaaaggaaaagccgagagaaagaagaaaagaacaaaaagacgcaaaggaggaagagggtaagtagacaggggagcagaacagagcagcaagacacacgagaacagaggaagcagaggaagcaacagaccagaacatgacacaaagatgaaaagacgaggaggaacaaaaacagacacaagatacaacagaaaagagacacgatggacgcaggagc

SEQ ID NO: 445422 - DNA, 2346 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaaaaaaaaaaaaaaaaaaaaaaaaaaaaaaaaaaaggggggggggcgccaaagaaatcctcccagagaggggggcccacaaccgatacgcgcggccaccacaggtttcgtggtggcacaaagggggcgccccaataaagggagggcgccgaattataaaaccccaagagagcgagagggggcgggagtatcacacacacgcgcagccacacggggagcacaacagggagaaaaggcgggggcgacctctgcggcgggaaggagagacccccctactaagatgagagaggggagggggacaccaacacggtggggaacaaccaaccaccacaggcgaaatacttaacgaaccgccctacgagggcgaaaaatatccacaactccctccaagccgggccccaacgggggggtgcacaacccccacaacgcgggccctcctagagagcggagccgcgccccgcgaaacaactcctgagcgaaccaaacgagggcccgaactcacaacatacccacgaccaacaacctttcactacacccccgggcaggaaccaccccagaaaaccaacaaacaccaccatcccccc

SEQ ID NO: 445423 - DNA, 2388 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaaacaaaaaaaacaaaagaaaacaaagaagaaaaataaaaacaaaatctaatgaaaaaagttacacatagtacccttagaaaaccagagccatcgtacccatagaggccccacacaaccggcagagcaaggctaaggccctacagctacttgtcatccgggaccaaatagctactcttagctgcaattctttgaacacctaacgttaaactttggaaaggcactgaattaaccaaattgaatgtgttgccgacttcaggcgcccatgcggcagaggatttcacggatatgccacgccctcatgattcgtttatgctaggatccttgtgttctcacttgagtgaacctgtggcttcagttgtatcaactacactaatctttcacagctcgcttggataacccttgctatggtgtctaagttacctcgaagcaatgttgcaatcgccatttatcaatttgctggtcctccttgaaacaatctctcaaggtttctagggctattggtaaatgtgccttccactctcctcaaagtgtttttcctccattatgtcagctttaaattgctaaccgtcacaagccccagtgaacactggcaactcggtcaaaccttgcactgcttggaaccc

SEQ ID NO: 445424 - DNA, 1818 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaatcagagctataccaccagttgtagattggtttttttacacagttgtatatatgtgacacccaag

SEQ ID NO: 445425 - DNA, 2442 bp, Homo sapiens
  misc_feature (1849)..(1849): n is a, c, g, or t
  misc_feature (2181)..(2181): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccanccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggttgcagtgcatcatcgaggagtcgggagagcacatcatcgcggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaanaagcacaaccggctgtacatgaggggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445426 - DNA, 1702 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccttcactgatacccggaaggacgagcaggagcgttgcatcaccatcaagtcaactgccatctccctcttctacgagctctcggagaatgacttgaacttcatcaagcagagcaaggacggtgccggcttccctcactcaacctcattgactcccccgggcatgtcgacttctcctcggaggtgactgctgccctccgagtcaccgatgcgcattggtggtggtgacctgctaccc

SEQ ID NO: 445427 - DNA, 1629 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcggggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445428 - DNA, 2330 bp, Homo sapiens
  misc_feature (1695)..(1695): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcggggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaaaaaaaacaaaaaaaaaaaacatcaacacaaacaaaacaaaaacacaaaaaaaanaaaaaaaaaaaaacaaaaaaaacaaaagaaaacaaagaagaaaaataaaaacaaaatctaatgaaaaaagttacacatagtacccttagaaaaccagagccatcgtacccatagaggccccacacaaccggcagagcaaggctaaggccctacagctacttgtcatccgggaccaaatagctactcttagctgcaattctttgaacacctaacgttaaactttggaaaggcactgaattaaccaaattgaatgtgttgccgacttcaggcgcccatgcggcagaggatttcacggatatgccacgccctcatgattcgtttatgctaggatccttgtgttctcacttgagtgaacctgtggcttcagttgtatcaactacactaatctttcacagctcgcttggataacccttgctatggtgtctaagttacctcgaagcaatgttgcaatcgccatttatcaatttgctggtcctccttgaaacaatctctcaaggtttctagggctattggtaaatgtgccttccactctcctcaaagtgtttttcctccattatgtcagctttaaattgctaaccgtcacaagccccagtgaacactggcaactcggtcaaaccttgcactgcttggaaccc

SEQ ID NO: 445429 - DNA, 1569 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgagggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445430 - DNA, 2346 bp, Homo sapiens
  misc_feature (1565)..(1565): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaanaaaaaaaaaaaaaaaaaaaaaaaaaaaaaaaaaaaaaaaaaaaaaaaaaaaaaaaaaaaaaaaaaaaaaaaaacaaacaaaaacaaaaacaaagaaggcggacgcccccacaaaaaagaacccgcgaggaggacgcacaaaagaaagaccacaccagcagcctcttgacgagagacaacgggacaccacaaaagaatgcgccaaataaaaacaaacagcacgcagcgacgaacgaataacaaagacgcgaaacagagaaaaaaacgaacagcgagacacacatgcgggaagagcaaccactcactcagcgaggggagacgcacacaagcgagagacacaacacacaccacagacagactcaacgccacgccagcgacgaacaaaacacacaccgcaagaagcaacaggcgcacaccacacaccacaacacacacacccagcaaaactgaaccgcacgagagcagacagaacaacaaatacgagcggaagctgatacagaagacgaacgagcggagcagcgacgacgaagcagggagcgacgacgcggagaggcgacggaggacaagacgacgagagaccggagacgcggagagcgagcccggccggcgacagccgccgcgaaggaacgacaaccacgcaccgacggagcgcgcggcccacgaggcggcggacagccagagacgcccgaagagagagagcagatagcggccggagcagggagggcggaggaaagggacgagaagcacagacagccaacgcacgagagggaagcaagcaagac

SEQ ID NO: 445431 - DNA, 1776 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggcccaacatcctcaccgacatcaccaagggatgtactgacgatgtaccagcatgat

SEQ ID NO: 445432 - DNA, 2294 bp, Homo sapiens
  misc_feature (1659)..(1659): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaaaaaaaacaaaaaaaaaaaacatcaacacaaacaaaacaaaaacacaaaaaaaanaaaaaaaaaaaaacaaaaaaaacaaaagaaaacaaagaagaaaaataaaaacaaaatctaatgaaaaaagttacacatagtacccttagaaaaccagagccatcgtacccatagaggccccacacaaccggcagagcaaggctaaggccctacagctacttgtcatccgggaccaaatagctactcttagctgcaattctttgaacacctaacgttaaactttggaaaggcactgaattaaccaaattgaatgtgttgccgacttcaggcgcccatgcggcagaggatttcacggatatgccacgccctcatgattcgtttatgctaggatccttgtgttctcacttgagtgaacctgtggcttcagttgtatcaactacactaatctttcacagctcgcttggataacccttgctatggtgtctaagttacctcgaagcaatgttgcaatcgccatttatcaatttgctggtcctccttgaaacaatctctcaaggtttctagggctattggtaaatgtgccttccactctcctcaaagtgtttttcctccattatgtcagctttaaattgctaaccgtcacaagccccagtgaacactggcaactcggtcaaaccttgcactgcttggaaccc

SEQ ID NO: 445433 - DNA, 1276 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaaggccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445434 - DNA, 1574 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445435 - DNA, 1527 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggagggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445436 - DNA, 1447 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccctcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445437 - DNA, 640 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445438 - DNA, 1278 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtccacctcctctgtgctgtccggacagcacagaggagggcactgcaggcgaagcagttgtgcttgctcattgcctcagcccaagtgtactcaaagaaaagaggcagccagctgtgcgtgctgtacggaaagcctccctgtgctgtccagctgtccacctcctctg
